United States Patent 10,221,454 (METHODS AND COMPOSITIONS FOR SCREENING AND TREATING DEVELOPMENTAL DISORDERS) - sequence listing, part 18

SEQ ID NO: 169 - DNA, 72415 bp, Homo sapiens
gttctctttgataatactgtttattgtccacggaccgagcgattgctcaagaatgatacaaagcatcagagacatgcgcagtctgcttgtcaactttcaacaactcttgtgtgttcccagcaccggaaggtctcagacttcatattccagcataaacacagtgctcccctcccccaaaaatccaaacggaaacaaaatcaacagagctttaaattacggcagcaagtccaatatttcttaatacttatcaagcaaagatttgaaaataactacaatgtaaactttattttaaatattttgagttgcttgcaggatgaaaataggagaagagagctgtgcttagaacataacatataaattaaacgatgccaaatggagagccttcttaaactatatatatattgccactatttattgtgaaggtatttgagcggcttcctctgtcagctgccacccggctcttcttaacctgttttgttttctgctcagcacggttaaaagaccaacgtgtgtggatcaaatataaaggccacacctttcagaccgaacctactcaaagatcctttactttgcaataatttgaactggagaaccaaagacgggagacgaatgaaagcaaagatgctcaaagaaccaaaggaaagacctgaaggaatccacctgcataggccacgcgttccactctgggtcaaatgcttccacgatgcagaaacctttttttaaaaaagtgcaagtctaatacctaccaagggtaataaaaaacacagcacaggaatgattacagctgatgtcaaaaacaaaccaaaacattaaaaaaacaatcagcagaaacaggagtaaatgttacatatgatatcaccatacaggaagcgaacaggggtggggtgttatatgggttggaggggtctggtggagttgtatatactgaaatcacatggactggtccattatgacatcttaccaactttaggtcactgtacagcatgaaaacgcccgtggggcaggggccgattcctggataccctcccagtctgccctagaaagggaagtcatcaagatctgtgctgaccaggtcccggtgggcatgggggctgcatgccacttgggggtcaggagtcttaacaggtgctttggggttgccgctgaatagaacaggctaaggtggctttggaagcattttgcaagaccacgcccaggccgccaagcttcggtttcattgcgtgtgtatgtttacataatgtgcctgtatatcgtcagtttatctttacaacacaggtgggaggaaacaagagattctccttatcattaccgagaaagttcttcctatcctaacccccatatcactggcttcaggaaaccacactgagggaacacataggttccctagttccctaggaagtttcttagctaggtaatctttgtcatttaagaaatacaagcagaagttggtatatctgcaactcaggttcacctatcatctgagaattcacctttagaaaaataagatgtctcttaaaacaggccatagtgtcctggaggctgagaaagaagtgagtgtgtcaccaaagccacctacctccaaaatccttcccttcctaggctggacttcttactatgcttagctggcgtcacatgcagaaagccccgtgcagaacgatggctgtcagtctttgagggagggaacactaagcctgggagggcacagcaagacccagctttttctgtcctcaggatgtgcagatggggagcccagccgggccctgcacacaagcccggataaagcaaagctgtgcaactcaatccaggtgcctgatgccagaacaggcaagaagcaatggcaaccgcagcagctagggaagggaccttgagggcagccaccggccccggacagcagcctcaggacaggacctcaccgattcctcctgcaagctggggagcatgtgggcgggggggggggggtgggggggtgggtgcagaccaaaaagactcagctgaggctggaacgcagctcagctggggtttctcgctcccatttctacaaggctcagagggaggctcccactggaattctgaggattaataggattgatggggctccttcaagaactagccactggttccaggctgcccttggatgtggggggagtcaggtgctgggagctcatggtgggcaccggggcgatgggagcacttgccaggggcagggagtgcagaggcgtggaagctgcagaaaacaagggccatgtccctctcaagatgaaagggacctggtaggcctgctacacagtcttgcaacgaccctcaaaagtttctgcaaaatgcacatttccaggccctgccctaacccagctgggagatccctaagtgctgcctgcttggcatctgtgacggtgccaaggcagggactgggagggaagccgcgtgtcccagccctgcctgcacccaaggatcgaagccccagacacatagtgcctggcagagggaggatgggatgaggaccttggacccacgtctccctccagacccacaaccatgtctaaaaggagaaggggggagcagaatcatattaatttggacccatgggatgagtgttttattcatgctgtttccaggaagggatgtcagagctggaccagtcgaaacccttggaggctttttttgcagttggccacaggggcgttggaggcctgcttatgggtcctcgatgtcgagaaactcctgcttggggggcgccgcgccgcggtaccacgcacaggagccgtcacttctcttgatgcaggcgaagaacttggcctggtgcccgttgatgttcttctctgtgacccagtccatccagaggcactcgtccggggaggagatgtagcacgggatcatggggcagcgcgtgatctggggaggggcacacggagggggacggagtcagggacccaggaaggggtgggcagaggctgctctgggggcatgtccagaacccggcaatgtgcctacctgtcatgtgcagggatggcagcctctcccgagacccacggttcctgcaggggcaggcagctggcctgcgagggggtctaacctgcagggaagctgtgccctgcccaccgctgccccccctcctactgcaggtgtgcttccctttgggccatcttctaccttcctgagcatgacagaatggcctcagcttggccctgccctctgggggacacagcaacaataaaagggcctgggtttcctggagacagattccagcccagtgttgctcgcaagccgagccccgaggtcatcggcaactagcaatttggccaaggaaccctaggctacaagaggatgaccgccttcaccaccgtggaaagaaaaaggaaaaacttgcttttgatttcatgctgggcacagaggagtttcgcttaacatacgtgtggctggagactatgagttcagaattcctgttttgaacatgcggagaaggggctgggggccgtcaggagggagggcagccccaggcagctccccagggaaggccaatccccacagcctcaccagagtctcctggtcccagactcactgggagtgacccagggtgggaggtgcccagcactcagccatgcttcctgcagggagggtggggatagggtgctaggagcccacagggtaggagccagcctgggagccctggaggcggtaatctcaccttccacagccacatctaggcgctgcactgctccagctgtgcctggcacaacctccgggctcattttaagaggagcaggtgttcaggtattctcaacacacagaccccacatagacaccaacccaggtgtgaaaatgtcgggaatgttggaaacagcgtaaggcctgcagtgccttctcataagccacacaggcgtttgcacttgcacatttgtagaaaattctccatgggaccatattctctctccccatacagctcctttttctggaagctacaggtaacagagctgaattcatgctcttactctcaaatctcctagccttccagacatctccctcttttttttttgggacagagtctcactctgtcaacccaggctggggtgcagtggtgtgatctcaactcactgcaacctccacctcccacattcaagcaattcttaagcctcatcctcccaagttgctgggatcacaggcgtgcaccacctcacctggctaatttttgtatttttgtagagacagggtttcgccatgttggtgaggctgatttccaactcccgacctcaagtgacccacctatctcggcctcccaaagtgccgggattacaggcgtgagccgcagcgcccggcctccagacatcccctgtcagagatgtgcctcagggctctccagggaccaggggtcaaaggctctgtccccagccagacagccttactcttgggatgactctaccttcccagagcctggtcttagatcaggagccggggattaacgggtcctggaaagccagggatcaaaatccctgccgtccatctggagacactgggaggaggcgatgctccagcagaggcaggacctgcttaccttgcactcgcagcccatctggtacctgtggttcaggctcttcttctgggtggtgctcagggtgtcccagggcacgatgaagtcacagagggtgatgtgcatcttgccgtccccctcggcctttcctgcggagagacggggatcaccgagctcagggagagggaaaagtcctcctcctgcccagctcctccacccggcgcaggggcgctgggatttcgttgcaacaatcctgtgcactgtctattctgagttaaaacacagtgggtggccaggcacggtggctcactcctgtaatcccagcactttgggaggctgaggcgggtggatctcttgaggccaggagttcaagaccagcctggccaacgtgatgaaaccccctctctactaaaatacaaaaaattagccgggtgtggtgtcacacgcctgtaatcccagctacttgggaggctgaggcaggagaatcgctcttgcaccccagaggcggaagttgcagtgagccgagatcgcgccactgaactccagcctgggtgacacagcaagactccgtctcaaaaaaataaaaagtggaaaaaaaaagaaagccataatgcatgttcactgacagaaacttaaacattggaaacaaagaaaaaacttcctggccaggggcggtggctcatgcctgtaatcccagcactttgggaggccgcggcaggtggatcacaaggtcaggagatcgagaccatcctggctaacacggtgaaacccccgtctctactaaaaatacaaaaaattagccaggcgtgctggcgggcacctgtagtcccagctactcaggaggctgaggtaggagaatggcgtgaacccgggaggcggaggttgcagtgagccgagttggtgccactgcactccagcctgggcctgggcgacagagcgagactcagtctaaaaaaaaaaaagaaaagaaaaaaattccctactttcattacccacagctaatattttgatgtatttccttccaatattccactattgattttgagacagtcttgctctgtcgctcaggccagagtgcaatggtatgatcatagctcactgcagccttgacctcccaagctcaagcgatcctcccgtctcagtctcctgaatagctgggactataggtgtgaaccactacaccctgctaattttttatatttttttttgtagaaacagggtcttgctatgttactcaggctggtcttaaacttctgcgctcaagcaatacccccactttggcctcccaaagtgttaggattataggcatgagccaccacgcctggccccaatattcttttaaattaaattttattctaaaaaaaggatagagacgatgtttcaccatgttgcccaggctggtcttgaactgagcttaagtgatcctcccaccttgacttcccaaagtgctgggattacaggtgtgagccactgcgcccggccaatattctcttctatgtgcatcttcacacataaaacgtcatgcagtatgtagattatattgtttcctgttttgtttttcacaaaatattaattcacaggtgcttctcccatttgagtttaaacttataattctgcatttttccattatgaagagccaaagcatggaatttttgaaaattaggaatctgctctgaattcccttcatcaggcatgatgagctgtggcttctttctgtacttccggctcctgactcagctgcctccttcctttgctgaagatactacattggcaatagccttggcgttttacaagcaggaggaaaagaacaaagcagtgtgttccagtggctgacagaacctaatgacagctatggaagtcatttaaaaactcatccctcaggccaggtgcgatggctcatgcctgtaatcctagcactttgggaggctgaggtgggcggatcacttgaggtcaggagttcgagaccagcctggccaacatggcgaaaccccgtctctactaaaaatacaaaaagaaatagccaggcgtggtgatgcatgcctgtaatcccagctactcaggagactgaggcaggaggatcgcttgaacccgggaggtggaggttgcagtgagccgagattgcaaactgcactccagcctgggcgacagagacagactccatctcaaaaaagaaaataaataaaaaataaataaaataaaaactaatctttcaggcagggcatggtggctcatggctgtaatcccagtactttgggaggctgaggtagggacatcactcgaggtcaggcatttgcgactagtctggccaacatggtgaaaccccgtctctactacacatacaaaaattagctgggcatggtcgtgggtacctgtaatcccagctactcgggaggctgaggcaggagaatcgcttgaacccagtgggcagaggttacagcgagaagaggtcatgccactacattccagcctcagtgacaagagcaaaactccatctcaaataaatacataaaataaaaaaaatacaaaaaattagccgggtgtggtggcgggtgcctgtagtcccagctactcaggaggctgaggcaggagaatcacttgaacccaggaggtggaggttgcagtgagtcaagatcaagccactgcactccagcctgggtgacagagtaagactctgtcttcaaaacaaaaaaaacaaaaacaaaaacaaaaaaaacctcatccctcctgctacaacagccccttgtgaagagacacaggtgtcagtgatgagcacccacgcctggcagagactgatgggcaattccttgagaagcagacagagcctcaggctgtgccctaagcacttttgtttgacaaagtttcagcgcatctgacttaatgatctcaggcacagcaccagcctcagaggatccactaatagaaacacagcccagcgaaggactaatgcagctcatcgactgcacccctgtgccatggaaatgtggatggcttgcctggggctccaagcagacacaagtggcctccattgtcctgggcacggggcactcattgtgccagctccctgggtttgaattcttatgctcgcacttcctgttctagctgttcctttatcttcgggtccttttctccgtttagacttatgtgacattccaggtgaggaacaggatgagaaagtagaattactcctgtaacatttattccaaatcctataacttcataaggtaaatgtttgggtggccttaaacaattcaaaactagctgggcatggtggctcacacctgtaatcccagcactttaggaggccagggtgggcagatcacttgaggtcaggagttcgagaccaacctggccaacacggtgaaaccccgtctctactaaaaatataagaattagctgggggtggtggtgcatgcctgtaatcccagctactcaggaggctgaggcaggagaatcgcttgaacccgggaggtggaagttacaaagagccaagatcgcgccattgcactccagcctgggcaacagagcaagactccgtctcaaaaaaaaaaaaaatcaaaattagatatataactttccccactagacctatagctattttctgtgagttcagaatagatcaggaaggagcaaaacagacagatggaaaggaacccattcctgtatcctggttgattctggcatttggcgcccatacaggtataccgcagccccttccctgtccagcctgggcacctgccactacagacaggctgaagctctatcctggcttcccagcttctatggtgatttccactgtatgtatcacttgaccagcattaactcccactttctattagatttgcctttcttctgcatctcgctccttaatcagagagtacgtatagagagtaagggctgtgtcttaacccttttgtttccacagttccctgcacatagtaattgctcaataagtttactgatgagacacacccgtgcttgttctaatgatatgcttcacattctgccttttcctgccatcttctcttttggccttttaccaccaattctggcttcctcaggaggtaagcaatggcaggaagaagagatgaagtgaaaattgtattttttcttttttttttttttggagacggagtcttgctctgtcaccgaggctggagtgcagcggtgccatctcgactcactggaacctctgcctcccaggttcaagcattctcctgccttagcctcccaaaaaattgggattacaggtatgcgccaccacccatggctaatctttgtattttttagtagagacacggtttcaccatgttggctgggctggtcttgaactcctgacttcaagtgatccactgcgcccagccaaaaaattgtatcttttcaatggtcctagttattgggctaacatgaacgtggctgtcatgtataaatgtgaagagaggaccgcctctggtctgattaagacttggttgggtgtacacaccgtgagcatctgcagcgatgttctacttatgtctgtctccgagaaaagcgaggcatgagtctgggttacagaaaaccgggaattaaaatttgtaacgaagggttgtatgtttatttttccttttggagaagaggaatgtagaagaaaattacagggccaactctgtatgagtctcctggtgcccgactcgacacgtgagactgagtcatcggtccaggaggaggtggcccgctcaggccatgcggtcactcactggccacagccagccagagctgagtggttcactgtgccctgtgatttctggttagcccctggataaagggtctatcctgactcgaggcaaactggatctaggttcctgcctcgggaaataaatgccagattcaatgtggagtcatctgaccaaggctgggaaagaagtcagatgagagaggttcctctcgccatgaggtgagtcagccactgtggccattaacagcttcacccctgctccccctcccagggagaggaggatgaagtaatgcagcctcattggtggagaagatacacagccagctggccactgggcaggtctcacaatctttgttgatttttagaaacaggaagtccatgtgcagatttgttacatgggtatattgtgtgtccctgaggtttggcatatgaacggatccatcgcccaggtagtgggcatagcgcccaataggtagaattttttcagcccttatcctgcttcctccctcccacctccttgtattccccagtgtctcttgttcacatttttatgaccatgtgtacccaatgtttagctcccacttttaagtgagaacatgtggtatttggttttctgtttttgcactagttcccttaggataatggtttccagctgcactcatgtggctgcaaaggacatgatttccctccttttcacggctgcgtagtattccgtagtatatatacaccacatttctttatccaagtcaccattgatgagcacttgggttgattctgtgtctttgctattgcagatagtgcggtaatgaacatacgggcgcagtgccgttgaacgatttattttcctttgggtatacacccagcagtgggattgctgggtcaaatgctagttgctttctcagttctttgagaaatctacaaagtgtgccccacagtgggtgaactcgtttacattcccaccaacagcgcataagcgttcctaagcgttccctttactccatagccttgccaacattggtttatttttattttttatttattttttttgggtggggggacagtcttgctctgtcgcccaggctagagtgcagtggcacaatcttggctcactgcaacttccgcctcccgggttcaagtgattctcctgccccagcctcccaagtagctgggactgcaggcgcccgccaccatgcctggctaattttttgtatttttagtagagacgggatttcactgtgttagccaggatggtctcaatctcctgacctcatgatccactcgcctcagcctctcaaagtgctgggatcacaggcgtcagccactgcgctgggctgtttttaactttttaactaaagctcttcaaaatctttcaatgtcagctttctaccgaggatcccgccacaggtccagggagcaatgccctttcagcagagccttcacgctcattctgctacaggctaccctagccctccttagaccttcagtatgactctctgtatcgactcaccagcttttcatgcagtgctgtgctgcgtgtatgggtcactgtcatctccagtgtaagacataaaattatcagctacccttgagtggggcctgaccaagataaccagcatctctgtgatcatcatttctggtctcctactcccactttcatcctctcaacaacccctcgtggggcagatactactgtcatcatcccccatgtacggatcggcatgggaggcacagacaggtaaagttacttggccaaggacattaacgagtcaggtgtcagagcacacattcgaactcgagcaggtgttttcagagccttcactcgggcatctcattgtatttcttcacatcttttcatgacacttagtcgttatctttttctcttctaaaacagagacagggtcccgccctgccacctgggctagagtgcagtggtgcagtcctagctcactgcagcctcaaatgcctgagctcaagagatcttcctgcctcagcctcccaagtagctaggactacaggtgcacatgaccacacccagctcatctcttctttccttccttccttccttcttcttccctccctcctttcttccctgcctctctccctctctccctgactcccttcactccctccctccttcccttcctcccttcctccatgcctccctcccccttcctccctcccttccttccttccttccttcctcccttcctgttttgtagagatagggtcttgctatatcgtccaggctgatcttgaactcctaacctgaagccatcctcctgcctcagcctcccaaaatgctaggattacaggtgtgagccactatggtcagcccatttccttattttctttatgcaataaactgtttgcacttggcacctttagttctgtgtcctcatcaaaacctcgtgcctcctccttgagatactaagtagtatctgagttaaaaagttaatggaaatgttaacaatttgaaaacatatatagaattcaacttagaagagtattacatattttggaaactttaaaatgtatgcacataaaaagaaataaaatctaccagccgggtgcagtggttcaagcctgtaatctcagcactttgggaagccaaggcaggcggatcacctgaggtcaggagttcaagaccagcctgaccaacatgatgaaaccccgtctctactaaaaaaatacaaaaattagctgggcgtggtggtgcatgcctgtaacctcagctactcaggaggctgaggcaggaaaattgcttgaacctggggggcggaagttgcagtgagccaagatcgcgccactgcactccagcctgggctttgttgcctccgtctcataaataaataaaataaaataaaatctgacccatgctacaacatggatgaacttgaggacattatgctaagtgcaatgcttcagctatggaaggaggtatgactctacctgtacgaggtgtctagaatgggcaaattcatggagacgaagtagaaaggtggttgtcaggggctgggcaaacagaggaacagggaattattggttaatggggagagagtttcagtttgggatgatgaaaaacttctagaaatagatagtgatagttacacaacactgtgaatgtacttaatgccgcccaggtgcggtggctcacacctgtaatcccagcactttgggaggccgaggtgggcggatcacctgaggtcaggagttcgagaccagcctggccaacacagagaaatcccgtctctactaaaaatacaaaattagccaggcgtggtggcacatgcctgtaatccctgctactcggaaggctgaggcaggagaatcacttgaacccgggaggcagaggttgtggtgagttgagaccacgccattgcactccagcctgggcaacaagacagaaactctgtctcaaaaaaaaaaaaaaaaaattagctgggcgtggtgttgggcacctgtaatcccagctacttgggaggctgaggcaggagaactgcttgaacccgggaggcagagattgcagtgacccgagattgtgccactgcactccagcctgggcaacagagagagactccatctcgaacaaaaacaaaaacaaacagagagcttcagcatgggcgaggattcagctgggtatgtttggacaccggtgctggctcagaccaaggtcacttttgcacccaagagtccttccgcagcgctgcagtttggccagaaagcccctagagggcagtgtgacgaaactgagctgggacggctgggacttactttaaaggctgttccctgtggataggaacaaacaggatgcagaaaactggaagtaagttccctgcaccacgggggattctgtctcctttcttgtctctccagattttatttttctgatgacaaacgtaataaatgccataattttaaaggtttaatacaggaaagaactgaaaaggagacacagcagatgctgacacgctgggaaatttcctcccgtgctctgttctgtgcacagctgcagcagcccccgaatgccacactgcagaccatgcctctgccacgcgccaccgtgcgtgctgtgcggccaccccagctctcctgcctcctctgtgttttttttgagggcattagttagctggtaagatctttgcaccacaggtggtttttgtccctctacccttctccatttgattttttttttcttattgtaaaaatcatagataatactgggcgtgtaaaatggtgcagctgctttggaaaacggtctgccagctcctcaaatggttaaacctaaagtcacccaacccctccccacccccgaccccaccaattccactgccagggatacacccaggaaaaatgagaacaggtccctgcaaaatctcacacaccaatgttcattgcagtatttgtcacaatggccaaacggtggcaacaacccaaatgcacatcaaatgatgaccggataaacaaaacgtggtctatccatacagtggaatactcagtcatagaaaggaatgaaattctgatacacactgtaacatggatgacccttggaaacacgaaagaagccggttacacagggtcacacgtatgattccgttcccaggaaagcccagcatagagaaatctatagagacgggaagtataccagtggctgcttagggctgggggagggggaggggagtcaggagggtaatagctcaagaatacaggatttctttttgactgtagtgatggttgcagaactctgtgacatactaaaaccactgaattgtaggccgggcgcggtggctcacgcctgtaatcccagcactttggaaggcctaggcgggcagatcacctgaagtcaggagttcaagaccagcctggccaacatggtgaaaccccgtatctactaaaaatacaaaaattagccaggtatgggggcacacatctgtaatcccagctacttgggtggctgaggcacgagaattgcccaggaggcagaggttgctgtgagccaagatcacaccactgcattccagcctgggcaacagagggagactctgtcttggaatgagaataagaaaagtgctcataataaaacattttaggaagtccagaaatgcatcttaaaagggggggaagtctcctattatccccaaggagagggatagaagtcttgatgaccgagatacccagcaaagcaggagctgtgagcatgttaaggaagggagggaagatcttacccaaggggagataacaggagtcttccctgcccaactcacagccctgcatcttcctccctgcaatgacctcctccccatccataggcaaggacaccaccttcttccagcagcaagtctgtctagacccttggacctgtgagagtctctcttccttttgtaccttctttttttttttttttttttgagatggagtctcactctgtcgcccagactggagtgcagtggcacgatctcggctcactacaagttccgcctcccgggttcacgccattctcctgcctcagcctcttgagtagctgggactacaggcgcccgccaccacgcccggctaattttttttttgtattttcagtggaaacggggtttcactgtgttagccaggatggtctcaatctcctgacctcatgatctgcccgtctcggcctcccaaagtgctaggattacaggcgtgagccacctcgcccggccccttttgcaccttctaagcattcacttactattcacaattctccacaagcaaaatctattttctttcttttccagtctccccattcggaacatctgtgtgctccatgatgaccagagccaaggatctcaccgtgggaatctcccattgtctctaacacggggctgggcacctaacaggtgctcactaagcacacattgatttttagaagggaaaaaagtacatgtcacctaaaccagaagaaaatcccccaatcatggatatttggatttggagtatatgtttatgattacagttgccttttggaacaaactatagtaccaggctaggggaattgtcttgtctcttctttcttttctcttttttttttgtgagatggggtcttgctcagtcacccaggctggagtacagtggcgtgatctcagcttgctgcaatctctgcctcctgggttcaaatgattctcatgcctcagcctcctgagtagctgggactacaggcacttgccaccacgcccagctaatttttgtatttttagtacagacagggttttaccatgttggcaaggctggtcttgaactcctgacctcaagcaatccgcccgcctcagcctcctacattgctgggattacagccatgagccactgcaccaggccttgtctattctttttttcttaagtttgtgatcagattcctacttccccagggaggaggggaataatgttccttaactggctgagtcagtgccatgctagactgcggctgccggccacatgtggctgtttacatttatactaaaattacttgaaatgaaataaaatttaaaatgcagctcctcggctgcactagccatatctcgggtgctcatgagccacaaggctgggggctgctggactggatggtgcagagaccgcttccatcactgcagaaagctctttgagcccagtggttctcaagcaggggcaatctaccccacctcccctgggcacatgtggcaatgtccagagaccccgcgactggagcgggtgctgtggcatgtagagggtgggggccagggatgcagctgaatatcctataatgcataaggtaggcccccacaacaaagaatggtccatccccaaatgttaatagtgctgagattgagaatcctgtcctggcctcctgtggttcagcctagctgggcaagcagaggaggccgtagaaggaagtaagggaaaataattttacttaggaataaaaatataggctgggcacagtggctcacgcctataatcccagtactttgggaggctgaggcaggaggattgcttgagcctcggagttcaagaccagcctgggcaacatggtgagacttctttaccaaaaaataaaaaaattagctgggtgtggtggcacacacctgtagttgatctcagcactttgggaggctgaggcgagaggatcacttgaccccaggagatcgaggttgcagtgagtcatgatcgcactccagcctgggaaacagagcaagactttgtctcaaaaaaaaaaaaaacaaaccaaaaaactataaacaaagagatgcaacaataaacaaaatgtgctacattcatacaatgaaatattattcatccttaaaaagtaaggacattttgggccgggtgtggtggctcacgcctgtaatcccaacactttgggaggctgaggtgggcggatcacctgaggtcagaagttggagaccagcctggtcaacgtggtgaaaccctgtctgtactaaaaatacaaaaaaaaattagccaggtgtggtggcgtgtgcctataatcccagctacttgagaggctgaggcaggagaatcgcttgaacctgggaagcggaggttgcagtgagccgagatagtgccattgcaccccagcctgggaaatagagcgagactctgtctcaaaaacaaaaaaaagagtaaggaaattctgatgtatgctgtaacgtgaacgaaccttgaaaacatgatgctactgaaataagccagacagagaggacaaacactgcagggttccacccatgtgaggcccctggagtagtcaaatccacagagacagaaagtaaaatggaggtgggccaaggctgaggaagagagaagggggagttagtgtttaacggggacggagttttggtttgggaagatgtggagacagatggtggtgatggttgcacaatagcgaatgtatctaatgccactgaagtgtacacttgaaaatggttggccgggcgcggtggctcgcgcctgtaatcctgccactttgggaggccgaggtgggtggatcacctgaggtcaggagttcgagaccagcctgaccaacacggtagaaccccatctctactaaaaatacaaaaattagctgggcgtggtggcgtgtgcctgtaatcccaactactcgggaggctgaggcaggagaatcgcttgaacccaggaggtggaggttgcagtaagccaagatcgcaccactgcactccagcctgggcgacagagcgacactctgtctcaaaaaaaaagaaagaaagaaagaaagaaagaaagaaaatggttaattaacatggctacattttgttacgtattattttaccacaataaaaaaaggagacagatgaatgaataagtcaagcaggtctcgtgcatagtatccacagatgttacgcgagcttttggccctcccgacggcagaaagggtttctctgccctgcatgtctccagcatcccgcactcgcctcccttttaggaacaaaaggcaaaaatgctcccttttttttgtccaccaatctcaaatttcccaggaaattggcaggtagtgaacattcactagcattctctgacgggaagtggccgagagggctccgtaccctgcctcactgttcctcagctactccgcctccccaccccccgagcctgggaaacgagccctggaccgcgtctaggaacagccccacttctgtgccagcctccggctgatggccccactcatacacacctgcaatgagatattccttctttcctccaacgtccagcgagaccccacacactgccgaggagggggccgtgtagataaactctatatccttctcaggccctttgaacatctggaaagacaaggaggaggacatgtaagcagagggaggccacacagttggtgaattccgttcccatccagaacaccctgggcggcacaacctgtagctggggtacagccagcacccaagaggaccaggaagtgcaaatacatgggttaggaaaagaccgttccagctgggctcagggctcatggctgtagtcccagcactttgggaggctgaggtgggcaggtcgcttgaggtcaggagtttgagaccagcctggccaacgtagcaaaaccctgtttctactaaaaatacaaaaattagctgagcatggtggcaagcgcctgtaatcccagctatgtgggaggctgaggcaggagaatcgcttgaacctgcgaggtggaggttgcagtgagctgagatggcgccactgtactcctacctgtatgacagagtaagactccgtcaaaaaaaaaaaaaaaaaaaaagaaaagaaaaagacttcttatagcaaagtgattctttggagtcactcaacttttagtgtggcagatcacagcaggtgagcacaagactcatctgtgccgggcgaagtggctcacaccagtaatcccagcactttgggaggccgaggcaggcagatcacgaggtcagaagatcgacaccatcctggctaacatggtgaaaccctgtctctactaaaaatacagaaatttagctgggcgtggtggcgggcgcctgtagtcccagctactcgggaggctgaggcaggagaatggcgtgaacccaggaggcggagcttgcagtgagccatgatcgtgccactgcgctccagcctgggagacagcaagactccatctcaaaaaaaaaaaaaaagactgtcatctggagcatgacatcctcagacaacacctctgttccctcaccccccaccccaaagaggtcatttctgaatctatggggaggggcttttgtacctccacgtgactctggaccaccatgaaggaccatgacttttgcatatttccaggaattttttatttttttgagatagggtctcactctgttgctcaggctggggctgcaacctcaacttcccaggctcaagtgatcctcccacctcagcctcccgagtagctgggactataggcgcatgccaccatgcttggcttttttttttttttaattagcagagacgaggtctcgctctattacccaggctggtctcaaactcctgagctcaagcaatcctcctgcctcggcctcccaaagttctgggattacaggcataagtcactccacccaacctatatttccaggaattttggtcaaatattgtctacttgatggcaatgagagcagagaggcacctcaggaattaggacataactccatgggccagaagagtttgctttctcaacatgtgatttactcacagcctttcaggaacgcacctgctgcccaggtgaagaatggcattttctcagcactcagggaggctgtttttttccccccgaagagtttcaataagcaaacccaaatggaatggaagcatgcctgatgtcatgacaaatggcttgagagtgacactccagcttgtaccaggaaaggttatgttgatgctgtactaaatgacatcatttgccaaaaggctaaaagcatttcctgggcactggcactggccttttcacgacccctttatgaggtcgtaagagcagatcctctttcctgcttcgtaaagaaagagactcaggcactgagagactaggtcatccccttaaactgacatacatgtgatgatgaagcattccactgaccttctgataacattgattttcagctacttttttttttttctttttttgagatggagtttcgctcttgtcgcacaggctggaatgcagtggtgcaatctcagctcacggcaacctctgcctcccaggtttaagtgttctcctgcctcagcctcccaagtagctgggatcacaggcactcgccaccacgcccagctaatttttgtatttttagtagatacatggggtttctccatgttggccaggctggtcttgaactcctgacttcaggtgatccactcacctgggactatactcatgagacactgtgcctggtttactttttatttttaatgacaaaattaaatatcgatgactacaactaccaccatatcacacggctgtccctccacctgcgacatgaattttcgtctctcttacagaccatgttagttactgtcaatgacaatagcatcacctctcctgccccaggccaggccctgccctccctgccctccctgccacatattttttttttttttttttaatacaagctctcactctgtcacccaggctggaatacagtggtgagatgtctcactgcaacctctgcctcctgggcttaagcgattctcccacctcagcctcccgaatagctgggaccacaggtgggcgctaccatgcctggctggttttttgtagagatggattttcaccatgttgcccagactggtcttgaactcctgagctcaagtgatccgcccacctcggcctcccgaagtgctgggattacaggtgtgagccgcaacgcccggacaggtttctgaaggaattgaatttgtggggagcatgtcatctccacacaacttttcaggcattcgaggattaagggaaatcggatctatttgcagcttgatgacctcatcctctgctctagtccacaggtggccagatcgtgttccagggacccaggctctctgccaaccccaacaccccacagctgtgcccacagtgcagcccgggatgccggcagccactattacctttatctgcttgatctcatactggatcctcttgatagggttgccataaatgtcgtttccagagtccacttccttctcactgaccgctttggccctgatcactgcaaaacacaagacacagaggtgaggagagttcctgaaacacgctcctggggctaaggagagggataagacgtccaggcctgcgggaggtgctggggggttacagacagcagcaaggtgcgagacgggcaaggggcatggtgatcccagcccccggcatggcgtctcctcctccaggctgagagatgatgcccagcctcctcctcctccttccacgattcttcaacaagaatcccttctttgttgacaggggcccaagccagaagcccagagtcccttgtgaccaaggcagtttctgtaacagtgggaggcagtcattgatttgactgaagctcatctgttgatatcatgcttgagtgcttttggctttttttttccttctctccagtgggtactcactggtggctggggcaagcaggtaccccatggaactgacccacaatcccacacattccgcgaaggatgggacatttccccaccctccagccacggcctattggaaacaagcttttctgggctgagggcagagggggagttatccaccttaaaggggccttaaacgtacccggcatatttagctttgggggtcttacatctggaaaggtctatccagctcttctcatctttcctgacctggaaaatgttctatgagtaatttttgttgttgttgttattgagatggagtctcgcgctgttgcccaggctggagtgcagtggcaccgttttggctcactgcaacctctatctcccaggttcaagtgattctcctgcctcagcctctcaagtagctgggattacaggcgtctgtcaccacgcccggttaattttttttttttttcagacggagtctcactctgtcgtccaggctagagtgcagtggcatgatcttggctcactgcaacttctgcctcctgggttcaagaaattctcctgcctcagcttctcaagtagctctgattataggcagctgccaccacacccagctaatttttgtatttttagtagagaaagcgtttcgccatgttggccaggctggtcttgagctcctgacctcaggtgatccacctgcctcagcctcccaaagtgctgggattataggcatgagctacagtgcccaaccttaatttttgtatttttagtagagacagggtttcatcatgttggccaggctgttctcgaactcctgacttcaaatgatccacctgcttcggcctcccaaagtgctgagattacaggcgtgagccactgcgcccagcctgggtgattctttacagtaacacagagtctatcaggggcacaacaggggcaggggcaggaagtttcacccaaaggagacatcggcaggcacagctggcagacccaagggacagatgctgaggaaggacaaacagaaggaaagaggatcccaactaagccccaaccaaacagaaaggagttggggaagaggctgggctggggcaattccagaatattctggagcctgaggttgctgacaggccatgcaacacagggctttctcctagcaattaagccaggattctgttccactcctggtaacctgaggacaagcagatcagtagttcatgctgtcacttgggcagggttgggtagagccctccctttcttaatttcaaggccattagttggtgacatggtctgttttaatggctttaaaagctttgccctcccaaactcagctcttcagggtcactctgggtaagtgttatgttacggtggatatgagcaaaacagagaggtaaggagcagaccacgccaggctccaggcagcctcctagccccagccccagccccaccccacgtggtcggctcaaatctcttagaaccccttaggcagggctgtctcttcccacaggggcaaggaggctcaggcgtgtgggtgctccatctgtgtccatccccctgggccccaccaatgctctctggatcccaggctggcatcagagtcccacaccacagccccactgcctcgcctgggcacaaacccctttcttctttcttcttctgttggagctgagtcatgactggccaaggccacaggttcctgtttcccaggctaatccatgcctcatcctgaaaagccacatctaggaaatgtctcccggcaggccactccagaacagacggctttgccctgacggccccctatttccagtgccctcctaaccatcctctcatccaccgcaaccagctgtctttttttattcacgttcgtttctgctcaaacatcatccttggctgccccctgccctcccctaaaatatgagcgcctttgcaacctgaagtcagccaggggcctcagctgctgtgcccaacaccccccacccatgctcccactattctaccacttcataatacttgtctgccctgaacacgcccaggtgcatccacacctctgaacagacaagtttctttctttcttttttttttagacagagtcttgctctgtcatccccacccctgctaggctggagtgcagtggcgcaatctcagccatctcccaggttcaaatgactctcctgccttagcttcccaggtagctgggattacaggtgggcaccaccatgcctggctaattaccatatatatttttttgagacggagtttcacttttgtcacccaggctggagtgcaatggcttgatctcagctcactgcaacctccacctcccaggttcaagcaattctcctgcctcagcctcctgagtagctggggttacaggtaactgccaccttgccaggctaattttttttttttttggtatttttagtagagacagggttttagcatgttggccaggctggtctcgaactcctgacctcaagtgatccgcccactttggcctcccaaagtgctgggattacaggtgtgagccaccacacccagcctgaacaggcaagtttcttccgccccaaatgccatctcccctctctgcctggagaacttttcttcattcttcaagacccagctaaaatagcccttttctgtcttcctctgggaaatcctgtccttctgcagcacttggtatattccccatctcttttccatcctgctgtcagttcctgcacacctgtctgctcagggccctgggaggtcctaacaggttgaggctagattctgactgcagaacagttggtgctcactaactctttgccagatggagctgagatgacgctgacaactttgggctggtggcccaggtgcagtttgtccttggctctcttgctccctgcctaatctatataccttacgacaatgctgcaccaaaaatgtttatgcaaattagtcaatgtgccagattaacttggtcaaagtttgctcttcatgtagcagagtcaccagctcacaagcaaaccagggccaggcacggtggctcactcctataatcccagcacttcgggaggccgaggcgggcggatcacttgaggtcaggagtttgagaccagcctagccaacatggtgaaaccccatctctacaaaaaatacaaaaatcccagccacttgggaggctgaggcaggagaatcgcttgaacccaggaggtgaaagttgcagtgagctgagatcatgccactgcactccagcctgggcaacagagtgagactccgtcttttaaaaaaagaaaagaaagaaaaggaaaaaaagcaagccagcagaatccaaaggaatcaacagttccagtaggagcagcaagccggcctttattacagtctgctgaattctgtatgttattttggaaatttctggagctgcttttcttttctttctttcttttttttttttttgagatggagtctagctctgtcatccaggctggagtgcaatggtgcaatcttggcccactgcaacctccgcctcctgggttcaagcaattctcctgcctcagcctcccaagtagctgggattacaggcacgcgccaccatgcccggctaattttttgtatttattttagtagagacggggtttcaccatgctggccaggatggtcttgaactcctgacctcgtgatccgcctgcctcggcctcccaacgtgctgggattacaggcatgagctaccgcgcccggccttggagctgcctttcaatggtccactaagccgcacaatgcttaacgcacaataggcactcaacaagcatgtcactggagttcagaaaataagcaaagattacttcaaaacggccaaaatgttgcatcctaccatgggcattgaggttcacatgctgttctcttacaaaaacgcctaaggctcccaggtggcagctgggcacttatttgaaggaggcagcaagagacagagatcctgcattcacccctggatggctgcgtgatctttgagaagctccttgacttcactgagccacagttgttcacacctaagacagagacgatgacaacagtcttgacacttcacaaggtcgtggtgactgttagaggggctggtgtggaggctgcggtgcccgggaactaatgcgtgtacagttcaggaccacgagcatcgcatagacaagcagggcgaattctcccgctcccgtgggtgagggattgggacggtggcatcatgccactcaggtacacagacccggtcctggtcagcaggccacagactctcgatttgatgcagcttcccagcgtgctagctttgcctgggggctgcagattacacactttccttctttaaagtgtcagaaaagaggaggctggtcaaatcaagggtccagggtagccacgtggggttaggactagaaagtgaactggcgaggaggccgccagatgcctgcagggaagtgggggtgaggggcagggaagtgggggtgaggggcctggaggagcagagcctgagggcatctccatctcccctgggctgctttagtctgcccctggggaacagaattcagattcttcagggtccctttaaattgggggtgggcacctcctcccccactttgcaaaatgagaaattacatgaaagaaggaaaatgggaatcaagagaggcaaagaaggaccagttccacggcaaccttccccaaagcaccagcacgccgcagacatgaaggagaggggccagctgacagctctgatcggtgcacaccagttggcatagcgggatctgcaccgctgacctgctcagagcagcgggtacctgtcgggggttgttgcccagaggtgacagcaggtgaagagagggtacagggtgaatcctgcatacagcaggccttgcctgggaggagcatccaatccaggcaagatgacagacgatggataggaacacagagaaggagagtttccaatgcccagtggtggacagaggaggagggagagagagctctccggaatacatttccatgccaatggcaatggtccgcactctgagctccaggatggaccaccagttctgtaggggaaagcaggccacttcaaaagagggagggcctctccgagtcccaggccatgtgaagaacagggctggggaaagcgaagagacataaggaatctgggaagaaatgaaaattgtggcacagacacgtttactgaacacctactgggtgctgggcctggtgttaggcactggggtgggtgtcagcccatctcctgtccatgcccccgagaggggctgctctgctcctctgccccttccccaaggagccagaggcagctgcgagagggggagtctttataaagactctcgttctaactgccctgagcccagaaaccacggcctctccctgggcgtctcagatttcgtttttccttctttcccttctgctgtgaacacaacatctgggtttgagatcaagggtgatacactggctgatgaattcaccgccagatgccggctactggaatgtacaaccgtcggctgaattcaaagcacacgcaactgcagggtccccacccccacccctccagcccaggacaccatatgatgtcacttcccccctgcaaaaacaatcccgagcgcacccgccagagtggggacggaaaagaaccgggtgggcggaaaaccaaggtcgcgggagacgatccaaagaggatgggctacggtcagacttcgacagtcacaaccgcccctggaaaaccatcagaggccggaccggctgctgctgctctcggaggggagcagacagtgaagggggcttgctggagaacctggtgtcaccagcatgtgccagggccaagggctggccggaggggcggcactctccacagactccaaccacgccagccccaggcagagacgccacggcttctgtggcacggtcctcccttgttctctctcctcggtgtcccctctgctgccatcaacacgtgggtcctgcgtcctcacgtccccttcatacacccaccaacatctttccaatcctcctgtgtccacagaagtactatggaagttcctgcggaaaataagaacaagccatgcccacaattgggggagggagacagaccccaaaagaaaattgcctcgaaaggccgggtgcagtggctcacacttgtaatcccagcacttgggaggccaaggtggatgggttgcttgaagctaggagttcaagaccagcctgagcaacatagcaatacctcatctataaaaaacaaaatacaaaaaacaaaaacaaaaaaaaacaaaaattagctgggcgtggtggcatctgcctatagtcccagctactcaggagaattgtatgaactagatgttcaaggctgcagtgagctatgaatgcaccactgcacctcggtcctgggtgaaagaaccagaccctgcctttgaaagaaaaagaaaattgcctgtaagaaatgtacttattccacactcattgaattctctttattatcttgccaggggcccaactgctcgctggaggaatcccacatgctatatgtataaatataccatatagaacattttccacttgagccactctgccgggctcccaggcccaagtttgggacaggcaaaccggtggatatcaacacccaacgtctagaccactcacagcctctccccggggcactccacacactgtaacagcatagcgcctgtctcggctacgggacgtgctcaggcagcgggagaaggtggcccactgtccctcaaagtcacctgtctgcccagacgaggtgcagggatccctgggactcagaaacacattcggctgctaaatacaaagtcaaaacccggcccgatcatctgcaccttgtgtgcacactgactcggactgggagggtttgctcagtatcactggagggcactggcccctcccagccgtccaccctcttctgcaggctccagctttcacctggggaggggcgcccataggaccagcactggcagggaaagcgcctccttcccctctgtcctgtcctgcttatggcccagcggagaacgccaaggggtccccatgttctcaacatgggtcattcctgggagtcgggtgggggcttcacacatgtgccaaagaccctactggcccacatcactagtgggtggggggcattctgatgctgcagctgggtcagagtcagcccagagcacccacagtggcaatgaagaccagtggccactgcatgcatcccaggggccagccctggaggactccacactgcgtagacgcaaacgcggtaactgcaggccggagccgcagacgtcttctgagcgtcatttggttcatttggctctgggtggaattacatgccagtcatttcagaggaattatcaaagaaaccattttctctcccggatgaaacccaacctccacttactcctggggaggatccaatggcagttgcaggtggactcagctttgttctttcactgggaaaggactgtgacgttccacgccttgtctaaactctccagaaaagtggggtgccatgagtgccaatgtccacaccctcaaatcacacagttagtaacgcccttgctaacatctgtaactataacttggcgttgccattggggatgagagtctcttgtcccttttgggtggatgtaatgacaccatatggctggtcaacctggcaggggctccatatcctcttttttttttgagatagagtttcgctcttgtcgcccaggctggaatgcaatggcacgacgttggctcactgcaacctcggcctcctgggttcaagcgattctcctgcctcagcctctggagtagctgggattacaggtgcccgccaccatgcccggctgatttttattttgtgtatttttagtagagatggggtttcaccatgttggccaggctggtcttgaactcctgacctcacgtgatccacccatcttggcctcccagagtgctgggattacaggcgtgagccacctggcccggcctgaccattttgattaatatgtctaaagcgccagctgagggtgtaccaggggcccctctgccccagccacccacaagatcagagtctgaaaagggaggtgaagcccactttccccacttctggtgtctacaccctcagctcaggacagatgtccagtaacacagctgtggccctgccctgcaactgctgtaataaatgactatttttcatggccctgctctcagatcgctgtgggatccctaaatgtttgtgtgtaactaatctcgttgggcttcaggatcacagtaaagacagcttagaaacatggaagctctccattcgggcagcacctccttcttttagcaggatggggccgacctcgccagctggagcagcagaagtggccacaaacgccaccagggatggcagacggtgatccaggaaggggctgtgctcacaaggaccccagacctgctctagtcctctaggtttggaggccacgcctctcccaacggaactgcccaggggcacggggcaaggctgagcagccaggaagtgtcacaagtgttgtgaggtgacagtgagggttagctggtccagctcaccttcagcctctggcctcaagtgacacagccgggtgcccttggtgggcagtcagagggtctcccccgggcactgggctctgcccttcctcggccccttcatgccagccccttttggtcagcgggtgcggcagacctcctccaaattcactccttttagggaaatgagcagaaaagagggccgtgacttggtaattaaaaacagccctgtggtgctgggcaggaaccaggctcttcccgccctgcagctgctgtggaggccagacccaccctcaggtcctccaacctcctcggcccccggaagccagcaacggggccttctgggaagcaggaaagacctcagcagagggggcaccataggagcacactggacatccgtccccagttgagggtgtagacaccggaagtgaagacatggggcaccacctccctttccagactctgaccttgagagtttgtgggtggctgggacagagaggccccaggtccaccctcagtggtgacttgcagccctggtgcagggcgggaccgtgacatccagggtgaggacagaggacttggccagcatgactcaggccagggtgaaaaacgcctggaatgacaactactcagaaaagatattttgttggggagggtgcggaggagggtggggcagagaaggtaacagggtgcacaacagagatcagggaacagaagcgcagcctcagccggggccacaccgcctgccagcgggcacctgggggtgctccaggccctgccgccccagggaatgctccctccccggctgcctgagattctagtgcacgtgagctgctggccactgggtgcccgtctccatggagaccagctctcccatctcacttcctgcccattcgttttggctcctcttgggaaacagcatctatcagagcacctcagccacgcagagcaaagccgccctctctgcccagccttcctgccgccctccccaaccccagggccctgccccctccctctgcagctctgggaggacctcggggcccacgtcccgctgccctccctttccctggtgggccagcaggtctcatgccagagcctccggctcggcccttcccattcacgtgctgctgaatcacttgaaaacaatgcaccagaccccgggaggatttgctgagaacagtgcggctttgtggagggaagtgcagctctgcattttctccgtcaagacccacggaacagccaagctcagccctgcaaaccctaagccagagccggagcagggacaggagcaggaccgtgcagggcaggaggcagagggagcctggagaggcaccgaggaaacccctacccatccctgcaacccgcccccctacaacagatgagcagggggccagggtgacaactccggagccaggggcagcagcagattctctcctcgcactgttgctggggggctgcgacagcgcgaggtgggcagggcactgttcctcccaagccgatccatttttggggacgaacgtgaggtccgggcccaggcttcaggctcattggcactgactgtctttgagccctggctgttcgtcggacccagggtcatgtggcctgtgggctgagcctgacttgctgcatttctcaggagacagaaacagggacatgaaggacatgaaggctggaatcccagggtccacacacccaggaaagaatgaaagcaggggggctgaggtccccactcccctttcccttcctcctcagcacagcttcccaaacaagccccatgctgagcggcgcccccagactccctaagcttgtcctggggggtgtgcatctgtgtagccccgtctccagctggaggacttggcctgggctgtcacagcagctgcaagtgcaggctgcaccccagccctccgccccgtgtcttcttggagatctcgatataacccccttgccatttgcacgaactggaagaatgaccacaggtcagggagggtgctctacccacccgtccactctaaaaaccctatttccttttgtcttatgtgtcggagatcctggtcacacagggcttgaaggggaagggagatttgtgcggagagaagatggacgccccagggcagctctcagggtggggtcacatccaaagcccaactggccagcaggttgggggggagcaggccaggaggtgaacaggtagcacctgccagaccctgctggcccccctcagcccatggacagctgacctcggcagaaagcacaagcaacgctgctgctccccgtccaagcctcacggaccaacagggcgacccacgcaccactgctcagccacggaggccttcctgggtccctgtggtttggggagaaggacccacaaggcagggagcaaagatggggccggaggacgaaggttccagcaaatgcagagtgaggcgcgaacacggaatctgtcccccaagggtgggggcagaagcaccaaaccagagcagagctctagaaggtgcaaagtgttcggagcaggagaaccgtgcggggtacctggaagtgccttaggatgaaggtgaacacggccaccacatctgggatcctcaccgctgctggcatggcagtgctctctggaaacctcaggagccccacacccttccgggtggctccatcccttgttttacagtcaaatgaaggctgggcaagggctggggtgtgagtccagggggcacccctgagcccgccaacatagccctatgaggtgcctggcacttcggggaggatttaggctcgcaaggcagggggcaggccctgtgcacttgtgtccggaagagaggtggtgggaagagagatgctggaagctgggtgtgaggggtgtgaggggtgtgaggggcaggaggtggagggccaggccttggaggaagtgcagaaaccttaacactctgcccaggtcacctagctgctggcaaatggcagagccagggctccaaccccggcagtagggctctcaccagctcctggtggaggctctgggtggaggcatgggacggggtgagccaggggaagctggaggctgctccacagccctttctaccgcagtccagctgtgccaaggtgaccaaggggggaggggaacacaggcactgccaggccctgggatggaaagttactcatgacatctccgtaagaatcactggagggccatggttttgggtgtggacatcctggagggctgttttagtgcccacaccaatgccctagttaaagaaccaccctgtccccttagccttctgcaggacaggtgggaaagggccgggtgtctggtcctgctgccaggggacagtgcaggtgtgaccgtccgggcagagatgagtcaccctccacactgtcttgctgcccgtctccacgcctagttttagctcgtgtggtcaagaaggggcgattcctcacctagaacacatgggtcacaaatgctacctttgaaaatggaaacaaaaataacccactcaaaggcaggctggttcccccatcagactgtggcttccaggctaaggcaggaagacctcggctactcaatgtttgggccccattgtggccatggcttttaactcagtcatgccataacaccctctctgccctctcagacagaggtgatgctacactgacaggcggctacgctccaggtctccgtgtgcaaaaaatagctgggcacaaggcaagtgcagaaacagcaggagcacggtgacaccccaccccgagaaatctatgtggcttttgaaaaacagcagccctcctgacccccagtttccttcttaatcatgttgagcctatagcaaattgtggagtggctttgcaaccctagcccatgacattctggaagcagaggatagaaagaaaccaggctaagatcaaaattttcttcttctttttttttccccctaagacagggtctctgtcactgaagctggagtgcagcggcgcaatcacagctcactgcagcctcgacctcccaggttcaagagatcatcccacctcagcctccctagtagctggaactataggtgcacgccagtatgcctggctactttttgtttttatagagacacaatctcactatgttgcccaggctggtctcatattcctgggctcaagccatccacctgctttggcctcccagagtgctgggattacaggtgtgagccaccatgcccagcctcgaatttcctctacttggcctgaagcagaaagccacagacaacagagacctaagctactaatgattaaagaacccaaaagcaaaaacaaaagagtcttgtgggatgctactcccgccccgtccaaatgagcgtaacgcttgttggttccacgagcttcgcattcgccagggaagtccggcttgagtttctcagaggcgtgcacttggggtcccactgagcaccttgtcctgcacagccatagttccagcttttactcactcatcatctgcgtcctccaccagaacgggagtcctgtggttccatgtgtgtggctcactgctcatctctagtgactgggacagtgtctaggactcatatctgtaaatttatttatttattttgagatggagtctccctctgtccccaggctggagtgcagtggcatgatctcagctcactgcaacctccgcctcctgggttcaagcgattctcctgcctcagcctcccgaatagctgggactacaagtgcgcgccgccacgcccggctaatttccgtatttttagtagagacggggtttcaccctgttggccaggctggcctcgaactcatgacctcaagtgatccacctgcctcggcctctcacagtgctgggattacaggtatgagcaaacgcgcccagcctcatatttgtaaattaaatattttataagagcaggtcaatctttttctggggaaaaaaaaaaaaataggaaaaaaaaaaaaagagcaataaacgggatctttcccacacctacatcccagctgtgccaaaagcactttttgacacccggtcctttgattcaaatgcatcagagatatagtcctctttttggaaacaagcacgaaactggagaagctatgatcctggaaagaagctcatacacgcgatgaggatatgctgcagtgaaaatgagtaagaggcgtttgtgtgatgtggatgaattcagtaaccgtgccgaggccaaaaaacctagctttcaaaagactccacataatatcctttttataaagttcaaaaccaagtaaaactaaacactatgtttagcatacatatatggataaagatagggagggctaaaccccaagttcagcaggtatatatctttttgtttcttttttttttttttccttttttgagatggagtctcgctctgacacccaggctggagtgcagtggcgcaatcttggctcactgcaacctccacctcccggattcaagcaattctcctgcctcagcctcctgagtagctgggattacagatgccaccaccacgcccggctaattttttgtatttttagtagagacagcgtttcacagtgttgaccaggctgttctcaaactcctgacctcaagcaatccgcccgccttggcctcccaacgtgctgggattacaggtgtgagccaccgcgtccagtatctttttgtttctgagacagggtctcgctctgtcacccaggctggcagtggcgtgatcacagctccctgtgcggcctcagtctctggggctcaaatgaacctcttgcctcagcctcacgagtagctgggactgtaggtgcaggccgctatgctcagctaattttttattttttgtaggatagggtctccccatgttgcccacgctggtctcgaattcctgggctcaagtgatcctcctgcgctggcttcccaaaatgttgggattgtaggtgtgagccatcagcaggtatatgtccaaggaggcagcagggggatggaaaagggaggtagcgcacaggtagtgaatattctgggtcttgggtctgggtgatgggctcatggtacttcattatattgtctacaaaatatacataagtaaggccattcgtggaccaatgatactaatgtgtcatgaacaaagattggttgatctaagtcaatgtatctgaggttgttggaagggagggagagagacagactctgaaaccatcctagtacagggatcagcaaactatggcacaaagggcagatgccgctcaccacctatttttgtagagtctcattggaacctggccacgccctttcatttacatctcatctgtggctgcttctgagcagctgcagtagagctgggtaattaccacgggggctgcacagctggcaaaggctaaaatatttactctctggctctttgcagaaaaagtatgttgatccctgtgcctgtccctaagactgcaattggcagaagagaagctacccagtgtgaggtctccatggctctggtggatgccaggtcagtggcaaagctagcggggaggaaactgatcaaacacccaggtgccgacacccttgccagccccagagggaatcacccagcggggcgagggtggcttgtcttctcttttccgtctactctcttttctcttaaagttataagaatgtattaagcgacgtgctatttaaacaatgttggttttgttgtgactttgaaagactaagaggttttagctttggttcaatctccgttaatgtctcagccttggctaagcactaagtgatctatctcctgaaattgtgcccgtctgaccttgggtgcccctgaaaggccagtgtttatttggctaaaacatctgaagggcttaaatgacctggagtctccatctgtgcctgtggcccctgaaaacagactgtcacccaggctggaatgtagtgacatgatcggctctgggagatgcatccacagcacatgggctagacacacccactgaaacccacacgggttcctatttttgtatataggtggtttcccaaaagggacttcgttttaaaggcaagactaggccaggcgcggtggctcaagtctgtaatcccagcactttgggaggccaaggcaggcggatcacgagatcaggagttcaagaccagcctagccaacatggtgaaaccctgtgtctattaaaaatacaaaaaattagccaggcatggtggcaggcgcctataatcccagctactcgggaggctgaggcaggagaattgcttaagcccaggagacagaggtactgagtcgagactgcaccactgcactctagcctgggcaacagagcaagactccgtctcaatcaatcaatcaatcaataaaggcaagattagggaaagagtccctgtgagggaatgtgccctggaggacggtataatgacagattgctttttttttttttttttgagacgagtctcactctgtcacccaggctggagtacagtggtgcaatctcgactcactgcaacctccgcctcccaggttcaagtgattctcctgcctcaatttcctgagtagctgaggttacaggcacatgccatcacacccagctaatttttatatttttagtaaaaacggggtttcgccatgttggccaggctggtctcaaactcctgacctcaggtgatcctgaggccgacctcggcctcccaaagtgctgggattacaggcgtgcgccactgcacccggccccagattgcccattttaaagaggcctaatagtctctgaggcaatgacgcaaacacagatcttagagacccgggtaccagtgctggcagcaccattatcagtgatgtatttaccccgggtgggcctctcgcatttagcatatgttctgaaactcccgcaagcatttccgggcttcttcaagaaactgcttgtgcaacctgttttgctgtaagatctgctgctgctggtctcggatcatctgactgtgccggtcgtcgtcggcgaggctggtgcccgatggggaagtggtgctgagctcagatcctctctccctttcctgggctctcgtggaggaggacttcagatgggccagtcgagctcttctttgctccctcctctctttttctagctcagctttgtagtggatttccaagctcatatctgggtgttccatttgttcaagcgattccagttgtttttgtcttctctgctccatctctgctttctgcctttgcctggatgccgtcgagcccactctgtctgcctggtcttgaaggtggagctgaagggagccctctgccagcgtgcccagtttgggggtctcttgtccagattcagtgctatacaataatgagtcctctttgttgataaatatacctgcctcgggagacaatgtttgacttccatttctaaacgtgggcttgaccgtgccctgatatttttggttctgggccttgcccatgaacgttttcaagtcggtcttggacgctgcctgctgcgcctcctcctctgctgggctcctgggttccccggcaggcagcatctctgggtctgccattttcttccctcttggggtcccagcgccacactcttgcatctctgagaaggcatgcccttccccaggtctctggtccatcctgggcttcagtgccaggtacaagcacaggtgttttttcagctttctgtttatattaaacaactcttcaaaggccaactccagctctttctgccacttgttcttctcccggagcgtgcactgagatgctggggacacggcttcccttctgcagctggaatcagctggccacagctgcccgaggtctctcagcttcccctccagactctgtccctgagagcgactggtcagggctggaacaaagcaaactgccccctttcccagttgcctcctccccgcccgagctgttcctttctctttttcctccacaagcccgatttctcccacagcagccacgagtgggtttgacctttctaggtccgcccctttgctcctccgaggatggatggcacagcggccacccccagacttggtcgaaggttctggccttccctttctcttctcaggcggggccaggtgagaattcatccgacccgtggcttttgtagtctgtggtttctctggactcgctgctgtcttccggggcctggagtgcctggggtgttgctggcccaactcttccctgcaactcctctcttcactaagggctgctctatgcttctccttggccctcgggggcctggctgatcttcgctggatgggcccctgcgagtcaggctcattttccctggcccgtcctcctccccagcccaacagacgtgctgactgcagcctgtccaggccaccgacgtgcaggtgctgtgcctcctgataccctctcctcaactcctcagccaagcgctggagctggtagtttttccacagcttggcatccgctcttctctgcagagcgagatcgcctttgccccgggcttgtagcaatttgtgctttttcctccaaagcaggtcttcgttatcaggacagaggctcagccacatggctccatccatgtttctgttcctgtctgcgaacccagcagatacagcttcccagggaaggtgcttggagccaagagtggagggttcaaggggcgcccccgggcctgaggagccacagaagccacaacgttccacagcaaacctacgaggaagggagcacaagtgcagctttccagatcgctcccaggagagtgagcaaagccctggagacaagcacacgggattctcactgtgaggacaggctgcaaaatgtgcccctccaagctctcttgacccgtgcccaccagggcccactctcagcctcccaatttctgtcctgtacacttttgacaagagcctgtagggcagctgttttgaacagagtgtggtgttgtttcccaggggacattggcaatgtctggaaacattttctattgtcacaaatgcagggaggaggtgctccgggcctgcagctgggtggaggcgagggaggctgctgaataccccacactgcacaggagggctgcccaagacagtgaataacctggccagagatgtcagtagtgccgagactgacaatcccacccaaagggcaagggttaggattcaggtagggatggaggggcacaaagggcagcccttggaaacaaatattgagaagagcaggtggaagtaaaagaggaagtctgggcctctggagggagaattgatcgtaaaggaaaggaggaagagacggggcagggaggagcctgccaagcatgtgtgtgtgcaggagtgtgtgcacgcgtgtgcaggggtgtgtgtgggtgtgtgcacatgcacatgtgtgtgcaggggtgtgtgtgcgtacatgtgtgtgcaggggtgtgtgtgcatacatgtgtgtgcaggggtgtgtgcaaggatgtgtgtgcatgtgtgtgcaggggtgtgtgtgcatgtgtgtgtaggagtgtgtgtgcaggggtgtgtgtgtaggggtgtgcgggcaagggtgtgtgtgcaggggtgtatgtgcaagggtgtgtgtgtctccatgcatgtgtgtgcaggggtgtgtgtgcaggggtgtgtaggagtgtgtgtgcaggggtgtgtatgcaggggtgtgtgtgcataggggtgtgtgtgcaggggtgtgtgcgtggggctgtgtgtgcaggggtgtgtgtgcatagcggtgtgtgtgcaggggtgtgtgcgcgcaggggtgtgtgcgtgtgcacatctgtttatgtttctgtgcacatgcctgcacatctgtgtgtacaggggggtgtacaggtgtgtgtatgtatgcatgtctgtgtgtgcctctgtgtgcatgtcggtgtgtgtatgtgtatgtgtccgtgtggggcatgcaggtatgtatgtgtgcatgcaagtctgatacttgaatccagtagaaaccagagaggaggagaagctggtgttagctctctcttcatgactcccagctctttccttttataatgatcagagaaggactcttccaggtctctttggcatcaggaagggacccatgctttggcaggccttcctaggaaaggaggggcatttacaccaaaacagtacgggattgtgtctgttgccacgggtagctgatgccagaaacagccagatctgtgagctgcaggaaaggctaagggacagccacagtcgatatggagtccccctccactgctccttcccttctttcatcttagtctatgtggaaccaggctaagcctttggagtcaaacgtagttgcagctgaagtcacatgtagttgcaggagtcagaaaatactgcatctacattacagctaacattaaccgtgcaggctcccctctgagcactgggcatgtatccgttcatcttttttacagtaatcctttgagatacgaagctcctaccccccccggttcacagacagggaaactgaggcaggcagagatgaagatgcttaacccagatcacacagctggtaagtggcagagacaggccctctgctgcttggacgaaccccagcacctttgaccaacctcaggtggtcacactgcagctggctttgacttaagtcttctagtgggaggtccttgcacctcttggtaaatcagatcacacaattagaatagtggttaatattatatttagccagatctgccaaccaccatgatgatcaagagagaaagggagagagaaagctgggcccttcaatgcaatgattgagatttttgacaaaggtgccacggcaatttaatgtggggaaagaatagtttttttgtttttcaacaaatgatgctggcacagttggatatccacaggcaaaaaatgggaattcacagccttatctcaccctatatacaaaaattaactcacaatggatcatagaccttcatctacaactataaacgcttagaagaaaacgtaggtgtatattcatgaccttgagtcaggcaaagatttcttagatacaacaccaaaagcacaaccaataaacaaagaaacggataagctgaacatcatcaaaattaaaagaaaaaaaaaacctttgtgcttcaaaaggtaccataagtaaagtgaaaatacaaggtacggactggaaggaaatatttgcaaatcatatatccaacagaagacttgaatccagaacatatgaacacctcttactacccagtaagatggcaaataatcccatttgaaaatcagcaaaagaaggacaggtgtggcagctcacacctgtaatcccagcacactgggaggctgaggcgggcggatcacttgaggtcaggagttcgaaagcagcctaaccaacatggtgaaaccccgtctctactaaaaatacaaaaattagccgggtgtggtggtacgcacctataatcccagctactcgggaagctaaggcaggagaattgcttgtatctgggaggcagaggttgcaatgagctgagattgcaccattgcactccagcctggatgacagagtgagattctgtctcaaaaataaataaataaaaataaaaatcagcaacagatttaaatagatatttcaccaaagaacatagatgtgtggctaatacagcacataaaaacatgttcaacggcagcggtctttagagaaatgcacactgaccctgcagtgtcctgccacctcacatccactccaacggctgtcgtcaaaaagacagacaatagcaactgtcagtgaggaaggagggggaggaattggaaccctgtgcacgctgctggtgggaatggaaaatggtgcagccactttggaaaacagtctggcagtttcttaaaaagggaaacacagacttaccctatgacccagagattccactcctaggtctataaccaagagaaggcctgagtccacaaaaagaaaccaaagctcagagaggttgaataactttcccagctcacatggaggagttggcctcagacaccaaagaccaccaggaacggccacagggatgtccaattaggtgtggtgaggtcggggctgctgtgaatgcccctctgtgtgtctcggaaggtgcctggaggccccaaggttcacagtctatttctgtgccaagagccgttggctcacaccccttgtcaaccaacaattagtaaaacctggacaagtcttccctgctctggaagtgcccccagcccgttcaatgacctcagtgcaccccgtgccagccccactggcgtgggcatcccaatgaagcagcgtcagttttcctggagacacgcaaacgggtaaaaacttaacacatttgggcagagatctttgggataagtctagaaaattgcagccagctccatccttcaggaatcgatccccgctctgacaccatcagatgcaacctcgtccccgctaccccagctctccttgctctcccctctgagaccctccccacttactaacttgaggcagagggcagggtctcacgtggacttgtgcaggcactggcagggaaagcaacagagccttagctgagcccaagatgaccaaggagaaacagccgttcacctgttgcacagcctgctgggatgcctgcctctgcctgtgatgcccaggctgatctccaggcagcccagtgtctctccagccctgccagacaggacgtcgggtgcccttggcaggacacttgccaatgaagacagccatggttccaatcagggccctcgctacagctcccctcccagaggcacctgccctctctggttgcttagaatattctagaaggggcaggggtcctggcgctcctctgtcctccacatcctctgagtgttctgagcatcctgggctgctttggtgttttctactcccctgctgccctctggtcctgccaccccgagctgacaagcctgccttctgctggctgccttcaaccactcagagaaaccacagctcccccctccgcagaagccgcgctcggagcagcagaaggaaggcgagtggacaccaatctggcctccggacggcaccagggcctcccacagagcggagtggacactgggcccattctcctctcttgctctctacagccccgtggccccagcgcaggagccagcccatggcagctccaccccagaccgatccgatcccagcacctgggcccaggaatgtgcttggccaccagattcccagcgattctcaccaaagtcaggcaacctctggcctacagcttgagaatgacgtccaagcagctcgcctttccctgggcggccgctcagacagcttttcagccaaggcagacctcacccagggaccctccacccaggcagcgtggaagtgccagggcccacagacagcacccccccgccccccgccggcctcctcaccccctccgaaggagactccaggcctgctgtgcactcctgtggcatcggggggcggggggcaagcatcacagtcatagggagtgtgaggcgcccagaatgggggctccacagtcaggcctgcaccccggctgcaggataccagatcctgtggttcactgtgagacctccgcctctctcgtctgcctcacgctgccccctcgcacccccaaggtatgacggcatttgaacaatgcacgtgcccatctagagccttggggtgggcctgtgagagagtggccgcccaccccagtccccaccaggtgcatagtcctgcggctaagtcagggcggttgtaacaaaggctcagaccctccaactaccaggctgtgttgtgacgaggctgctggagccccaggcaccatgacgggaatgggtgaatccacccacagtgggtgactctcaatgtgatactagcccggtacacttagacacccaaaaatcaacgcggcagacgttgtatccccaggagaaggacccccccgaacagacacgtgggacaatggcaagcatggccatccctgaggacaatggcaggacccagagtgcctctctcctcctcaaggcatgaactggcccctccagatacagggacaaccttttcttcccacctcggcctgtaacagacacgacacaggccatacccttggctagagtcactgcaacatgatccagagggtgactgtgaaaggagccagcggggctgctgtgtcggttttcctggagacacggaaatgggtacaaacttaaaacatctgggcagaggtctttgggataaagtccagaaaatcacagctggctccatcattcaggaattgatttcccccatgacaccatcggatgcaaccttgtccctgccgcctccagctctccttgatttcccctctgagctcacaaaaagaaacaaaagctcagagaggctgaataactttcccagcttacacggaggagctgggtttgaatccagacatcacactgatcagcacgcagacccgcagggtttcatactcttccggcatttcacgtacacctctctccatctcaccgcctcaccataggaggtgaggcctattcctatccgcacaatctgacagggaaattgagactcagagaggttaagtaacttgcctaaggccacatagctcgtaatcagggcagcagggattccgggccgagcaggcaggcccctgatccaggctcctagcctgctgcccagggaggtcagagctggaaaccacttccacagcacaaggagactctgcttggactgtgcttggcctcacgtgacctctgacctccctggccctcctgtgaccctgacaggtgtgctgagcttctgaagggtgggaaggcctgcaaggggcctgcgtgcattctgtgtgcatcgacccaggacaccacggttggtgcctctgagttcatcacgtcgatcatccccatcttctttctgctcaagtacttgatttgtcaacatgcacagaagggtgagacctggccatggtgctgcttgaatcttgttaacagttaggctctgattcaatagtctgggtggggcccaagactctgcatttctttttcttttcttttttcttttttgagacggagtcttgctctgttgcccaggctggagtgcagtggtgcaatctcagctcactgcaacctccccctcctgggttcatgcaattctcttgcctcagcctcccaagtagctgggactataggcacgcgccaccatgcctggctaatttttgtatttttagtagagatagggtttcaccatgccggccaggctggtctcaaactcctgacctcaagtgatctgcccgccttggcctcccaaagtgctgggattccaggcatgagcccccgcacccgccagactctgcatctctaaagtgctgggattccgggtgtgagcccccacgcccgccagactctgcatctctaaagcgctcccagggatgctgatgctgccatctgggggaccacgcttggagtactgcggccctggcaaaccatctcttccaggaagctgcatcttgctctgccttcctcccctgccagcagctcagccctgatcatctctcacctgaggcccttaaaagcctcccaatcagcctctctgcccccgacccccaggcctgcaccccgtcctctcccgcactgcagcccagcgctgtctaactgagagacctgggttacatttcagcatcccccatgtgattccctgctgtccacaccagcaagtctctgagtgcaacccgcagccacgtgcatcataatcagctgagctgctggtgaaggggtagattcctgggcctcacccctgacagatcctatcccagcccctgcgggaggggcccaggaatgcagccagttcaccagctgccctgccaaagcctggcaatctctgggcctagaggcttgagaacggtcaagcagctcgccctggctcccctgggagccaccctagcctggaacgctgcacaccagacaggggtggtagagctcctggccattcccaaatgccccacacccagcagcgcctggaatgtgctcatgcaggttcctcgtgacatggacacacccccttccccatcctacccgcatgtccccagcccaggcctcgttcccactcccccaggatgccccaaccctccaagggaacaaagagaatgctcttccctttctccagaagcccagcacccgggccacatagtcaagcgctttgtctttgaaacataaaaatagctatagaagggctccgttagctggcatcggccagagagagaacatttccatataattagagcttaccctttcatatggaaagttagacatttctctgtctaaggcgcctacgtagaatatgtaatttgaccttctttgggggaaattttggattgtctttgggatgataatataggaaatccctcgagggcttttaaaatgtaaagaacagaggtcccataaactaagtgaccccagaatgcaatttgggttttttaagtcgcctttttagagcttcctgtgtcctcccttccctggtcataactgtctgacagcagccacacaaacaagcttattaaaattgtggtttttttggccgggcgcggtggctcacgcctgtaatcccagcactttgggaggctgaggtggctggatcacctcacgacaggagttcgagaccagcctgaccaacgtggtgaaacctcgtctctactaaatacaaaaaattagccaggtgtggtggtatatgcctgtaatcccagctactcaggaggctgaggcaggagaatcacttgaacccaggaggcggaggttgcagtgagccaagatcgcaccactgtactctagcctaggcaacagagcaagactccatttcaaaaaaaaaaaaaaatgtgttttttaataaagtaagtagagtccgaggtggtggtgggctcttccacaggaccactgcctgagctttcacacctgaccttatcaattcaaagctgtgggcatccccggatacagataacccttgggggaggtggaaaattgttgctagactctagcctagaggtttttaacagcttgcacaactggccaaatcttacaagataaaaaaaggtaatgggaacacatctaaaacttatatgtgggtccctaaatccaactatgcaagtacagaggtgggtgtgtggagcagcacaggggacaaaagacgctgggccaccagaagggccaacgtgactgtcccctgagtgaacagaaacgcctctaacatgcgagcgaatggtgcagcccagccagcccgacctcacctggccatgctaggaggcagtgggcaagcggcaacgctgtggtgcccaggacgccggcaggcacagcgccacgtccacgggcaccgcccgttcccaccctgcaggacgccacagcatcagacgagacggcccgtgtgaagcgccgagaacagagtctggcttccgggagggctcaggaaatgccgagagctcggcagagacacccacgtggtgctggattccacgcacgaggaaccgacgggcagacgtggagctaaatgatggtcaacagctacgaagtgcctgtgctctagaaatggccaatttgatcatgtcacgggataaagtttcaaaatcaataaaaccgtgatgaaatgatcaggaataaacctgtccagaactgttcaagacctaaaggagatgcacgggctgaagaacaaggagcaaatctgaacgagggagaggtgtgtcttcctggacagttctcgggagaggaggagggcggtaaggacggggagaagaggccgcaggcttggagtccaggaggagaatgaactcctttggtcaggaggggcccactgaccaaaggtcctaggaagaaaagccaaaggaggtgaggtggggcaagggtgtttgcaaaggatagaaaagtctagaatggcagagtatggtgcttaagagtactatgtgacctaggccaagcgacttcactctgggtgcctcagtttgctctttaggatggggatgataacaacagcagcacccatctacagagatgccagtgcttgtcaccacgagaagcacctgaaatgcttggggaagaggggtggtacttactgtgtgtgtctccagatgactgagctagaccacccagaacacattacagggaggcagaagctgacaggagggcaggaagcactgtctccagggctgtcttgaaatcactgggctgactttgtaggtagtgagacgcccatcactggaggcatccgaaccaagcccagataaaacaaacatcagaaacatttttaactccgtttctctgagttctagcctctaaaaataccctccatgacacgctgtgtgctgccagaggcttggttttcgccctcttctccccaactcttagccacgtcccagtggtggcggggggacgggggtcccaagccactgcactgggttttggtttcactatgttgcccaggctggagtgcagtggtgcgatctcagcttactgcaacctccaccttccgggttcaagcaattctcctgtctcagccttcccaagtagctgggactacaggcgcacgccaccacacccagctaatttttgtatttttagtagagacggggattcaccatattggtcagactggttacaaactcctgacctcaggtgatccactcgcctcggcctcccaaagtgctgggattccaggcatgagccaccatgcccagcctgcactgggttttggactggctgtgttagcatcacctggggcaggggtgggtcacgttagaatgagtcctggctaggcccacagcaggcttttccacccgaatactggggccacagctcatgaatctgtgtgtatccatatcctgggctgggtcagctctccagggtggagatggttgggcaggcagcctctgggggcaagctcgggctcaggcctccccttgaccagcttcacagagacagacactgaggcagactgacctccaaactcccagctgagacgccagctccccacgtggggggcttacagctgatgcaaccggtggctcactaaacatacctcgacagcgtccattaccgcttccctgcaaacctcaagatcctaagcacccagcctaggtcaggggtccccaatcccagcaggtgttcctgcttcctgaagaccccccagcccaactcctccaacaaccatattcatctccaacccagtcccaccagcttccctcactctccttcccatcacactgcctgtggggagccccgtggtgcagggactttgccgctggccttgcgaacccacggcttggagcccctccttggcccactctccggggccctcttgggagcctcgctaaacagctgggcatggaaagaaccccaccctcaccacagatgggaacagacacagagagcctcagccccgcagtggtctcaggggcccactgaccaaaggtggccggaatcgcttccccgcctccacctgcagcccggcctctgccctggctggctactcatagcaggctgttgccatgggaacagcagagctgttgagctgtgacatcatggcaggggtgaggtcagggacagctgtgagccagccagggggcaagcgtgtaggttaggggatcaatcataaagatttggctcaagcagccgggagccatgggggcacctgaaggcactgtttaaggaggtgtgggtgaacaaggacagtgcaatgtacaaatgctcgtggccataccaggcagaggacatctttttgtccccagctggctgcatggagacctcccagggtgtcattctctctgagctgtcaggccattaaggaggtacacttcaaggtcagggttcctgacaacgcctgccatcccttctcctgtagggacagcatctgttcacgcttctaaacagctccagaaagccatcgttaaactgaaacccactggaggcgggggaagaaagaatcccgtcaaccacctgcccacacaggaggagaagccacacgtacttggcctcgtttgagggctagttccccacagacagtttgatcagaaggatgggcgagggaagctggcagggcgaggctggggatgaacatgggacactgggggagtctggccggtgcagggggtttccaggaagcaggagtagctgctggaaatgggggcccctgacctagtctgggtggttggcatcttaaggtctgtggtaaagtgatgactggcattgtcaagatatgttttttgtttgttttttagacagtcttgctctgttgcccaggctggagtacggtggcgcaatctcggctcactgcaacctctgcctcccgggttcagggattctagtgcctcagctttctgagtagctgggactacaggtgcatgccaccatgcccagctaatttatgtgtgtgtgtgtgtgttttagcagagacggggttttaccatgttggctaggcgggtcttgaactcctgacctcaagcgattcccctgcctcgacctcccaaagtgctaggattataggcacgagccaccgcccccagcccaagatatgttttagtaagccgccagttggatcatctgtaagcaactcactagaagcttccagcatcctccacaaatttgacaactgagaaatgtggctgggaaatcatgatttgggtccgaagaagtgaaagcaacaatcctcaggttgttgtttcttgagagaagaaggtaaacagcaggaattcggctgaggtgtccaaatctcggggaggatgaattctcaggagagctgaacctgagacaaagccctttgtcctgggctggaaggaccctggaaaggttatctggtccctgactcagggaagggaggcattctccctgcaggaatgttctcgatcacagtccaccaccacccccctacccccgcccacttttggagtccatcttcgcagcccttgatgattcattttatgtcagcttgacgggctaagggatgctcagatagctgggaaaacgtgatttctgggtggctctgggaagagactggcatctgaaccgggggactgagtaagaagatccctcctcgccaggtggggcaccatcactcaatctgttgaaagcccggacagaacaaagagacagaggcagaggcaggcaaaccctccctctgcaagagctgggacatccaggctgggcgcggtggctcacgcctgtaatcccagcactttgggaggccgaggcaggtggatcacctgagctcaagagtttgagaccaggccaacatggtgaaaccccatctctactaaaaatacaaaaatgacccgggcgtggtggcgcacacctacagtcccagctactcaggaggctaaggcaggagaatcgcttgaaccagggaagtgaaggttgcagtgagccgaaatcgcaccactgaactccaacctgagcaacaaagtgagactccatctcaaaaaaaaaaagagagagagctgggacatccaccttctttctgccttggacctcagagctcctgggcctcaggcctttgggctccaggacttaccccagtggccaccccgcttctcaggctttgagactcaggctgcattactgcaccagtgaccctgctgctccagctcacagacagcagattccaggacctcccagccttcatacttgcatgagtcaattcccacataaatcccatcttacgcagctggatggagcctattggttctgtttctctgggaaaccctaatacggacccatagatacaaaatcttctatatgcttcttcctcggagaagatccctacatcttttatcctctcagcgtggccttgacgcccattctaaagcaaggggagaggttctagtgaggaggaaatagcatggggaccaacaggatggcacgctaggccttcgatggcccttgcagaatgtccagcacgactgccaagtgctcgtcaggtcttttctggactgaggacatctctctcaagcctgggctctcctgacgctgccttggcaagctctagaaggcagccccatcctctggattaatccgccctgctaaatgttctctctggcatgggattcactactggcctaaggccaactcagccttgagagtctgggtccatactattgttgactgcaattagaaccacatattagcaaatgctagcttttaaaaattacaggtacaggcagacctcagacatactgcgggttgagttcccacagaatcataataaagtgaatattgaaataaagtgagtcacatgactcttttggtttcccaaaccaatatatattcccaaatataaatgttatgtttacattgtacagtagcccagtaagtgtgcaataacattatgtcttatcaatgcacataccttaatttacaaatactttattggccggggcagtggctcacgcctgtcatcccagcactttaggaagccaaggcaggtagatggcttgaccccaggagtttcagaccagccaggcaacacagtgagatcctacctctataaaaaactaaaaatagccaggcatagtggtgcgtacctgcagtcccagctactcaggaggctgaggcaggaggatggcttaagcccagaagttcgaggctgcagtgagctaagatcatgccactgcactccagcctgagtgacagagcaaggtcctgcctcaaaaaaaagaaaaacccaaaacttgaagaaataaaaataaaaataaaaatattttattgcttgaaaatgctaacaatcatctcgacctagtgagtccagtctttttgctggtggagggtcttgcctccatgttgatggctgctgactgatcagggtggtggttgctgaagattggggttggctgtggcaatttcttttttttccttttcttttttatttttattattttttttgagacagagtctcgctctgttgcccaggctggagtacagtggtgcgatctcggctcactgcaacctccatctcccgggttcacgcgattcttgtgcctcagcctcccgagtagctgggattacaggcctgcgccaccacacctggctaatttttgtatttttggtagagacggggttttaccatgttggccaggctggtcttgaactcctgacctcaggtgatccccccgcctcagcctcccaaagtgctgggattacaggcgtgagccaccgtgtctggccggcaggcccactttcttattatttgtgtgatcacctggagtagcattttttaatttccttcacattcacaacttggctgtttggcacaaaaggcctagctgtcagcctaccttggctttcaacacgccttcctcactaagcttaatcactcctagcttttgatttaaagtaagagacgtctcgctctgtctgtcaagcttgaatgcaatggtgtgatctcggctcactgcagcctagaactctcaggctcaagtgatcctcccgcctcagcctcctgagtagctaggactacaggcatgtgccaccacacccagctaagttctttaattttttgtggagatggggtcttgtcgtgttgcccaggctggtctcgaactcctggcctcaaggtgatcctcccgcctcagcctcccaaagtgctggaattacaggcatgagtccccacgcccagtcccattatagggtaattaattggcctaatttcaatattgttgtgtctcaggaaagagggaggcctaggcagagagagagagaccagaagccgccagtcggccagttggtggagtcgtctgaacacagacaacatggatcaattaactttgccatctcatgtgggcacagttcatggtgccccaaaacaattacaacagtaacgccaaagaccactgatcacagatcaccataacaggtatgataataatgaaaaagtttgaaatattgcaagaattattaaaatgggacacaaacacatgaagtgaacacgtgatgtgagaaaaaaatggcaccgatagactcagagttgagccagccgtgatattcaattcatgaaaacgcagtatctgcagagcacaatatagcgaagtccagtaaaacaggtgcacccatggaattcatgttcattctagagcaactggaaaatacacccttgccaaagaaagtctaatgtcccctcatgtgtccaaacgttctggccaggtgtggtggctcacgtctgtagtcccggcactctgggaggccgaggtgggaggatcacttgagctcaggagtttgagaccggcctgaacaacatggcgaaaccccatctgtactaaaaatacaaaaacttagctgggcatagtggtgtgtgtctgtggtcccagctacttgggaggctgaggtgggaggattgcttcagcccagggagcagaggttgcagcgagtggagatcgcaccactgcactccagcctgggtgacaaagcgagacactgtctcaaaaacaaaaaagaaaagaaaaagctataccatgtgatgtctgcagagcatctgatgctgtgatttatttaaccacgcccctgctactgtatatataggtgtttctaacgtttccgtaagataagcaagacggagatgaatatccttcagctaaatacttccatgtgtcctaaattatttctctcagaaaaactccaagatatagggctgcctgatcaaagggaagacttatttttaaagtccttgatcactgctgccaaaatgcccttccatgcctctaaactactcaaattaaggcaaaatatacctgtcaccaaggccttctgaggacaacatgcctcttggccaaaaggagcaaagtgatgttaaatccaaagctgtgaaatctaatcttcttcccagagactcgagccaggatcattccccttggattcctggcactgccactctgtgggtgaccttgggcaagtcatcggctgctccccatccaaacacctgcctcacctcccccgcagagcctttgtaaataaggaagatgtgaagtcctttgtgctgaaaagccctcgacagtatttttatgcatttgcctggttgttttatccctgctttccagaactagtgcacagaagggaagaccaccacagactgttcctttattccctgccctggagccaactgggccaagtggacaagacctcacaagggagagtcaggccagcaatgctcatcccagctccaccctgaccccattcctcttggcatactcagtttctgcctgggctgggcaggctggtccttggcttctggggtcagctcaggattgaggatgaaatgagaggagcacccccagaagagaaagtgctgaaccagaagcccaggagagtcatgtgtgtgcgtgtccatctaagcctttgccccaaaacagtaggtaggtcaggtgcagtggctcatgcctgaaatcttagcactttgggaggctgagatgagaggatcacttgaacccaggagttcgagaccagactgggcaacatagcaagatctggtttctaaacacaaaagtaattttaaaaattagccaagcgtggtggcacacacctgcaatcccagctactcgggaggctgaagtgggaggactgcttgagcccaggtggttaaagctacagtgagctaggatcacgccactgcactccagcctgggcgacagagcaagaccctcatctctttaaaaaaaaaaaagataaatcaaggagcccacctgtccccagagctctcctgccacagtgtcagcacatgccttctgagcataataatccccccggacctgaagcccacgaatgacccccccacccagtcctttctccctcatgtcacgtcaagtgctgtgtcactgaagcaccccgtaccccatcacctggtgccagaggcctggccatggtgcagctggacccccagctgcccgtgtgaccgtgggcaaacggattatgtcaccttcccagtgttagagagacccagtggtgacaaacgtcctctgtacctagggtcaccgtaaggctcgggtctcatcgggtttctgtacatgctctagacgtgcagcgtcatgctaccgacactccaagtagccggccttgctggcactcctggctttctcccttattccaccccccgccccccacaacattacgggacccaggccgggcactgtgacccaggcagtgtggattctcaactagctggagcaaacagggaactagggcacagaaaaggcagagtcacacaaccggaggcggagtgtccgtctagtactgggacccggtgtgatgctttaaggaacacacctgccgtccttatgtgagctgggctgggcctttatttttaatggacacataattgtaatatttatggcatatatagtgatgtttagatacatacaatgtatagtgatcagatcagggtaattagcacagccatcatctcaagcatttctttctttgtggtaggaacattcaatgtcctccgagctatctgaaactatacaatatacttttgttaatttctttttcttttttttttttttgagacacggagtctcgctctgtagcccaggctagagtgtggtggcgtgatctcggctcgctgcaacctccacctcccgggttcaagcgattctcctgcctcagcctcctgagtaactgggatcacaggtacacaccaccaggcctggctaatttttatatttttagtagagacaaggtttcaccattttggccaggctggtctcaaactcctggcctcaggtgatccgcccaccttggcctcccaaagtgttgggattaaaggtgtgggccaccgcctggcctattgttaattacattaatccaacagtgacatggaacactataactcattcctcctatctagctgtaattttgtatcctttaacaaatctctccctctctcctcccccaacccttcccagactctagtattctctgttctacttttgacttcgatgagatcaacttttcttttttttagctttcccatatgagtgagaacatgccatgtttaactttctgttcctggcttatttcacttaacgtcttccagttccattcatgttgctgcaaatgacaagatttcattctgttttatggctgagtagtatttcattgtgtagatgtaccaacatccacaatgaaatactatttcattctttagccattcatctgttgttggacactgaggttgattccatatcttggctattgtgaacagtgctgccaggaccatgggggtgcaggtgtctctctgatgcactgattccctttcctttggataaatgcccagtcgtgggactgctggatcatatggccgttctatttgtagttttttgaggaacctccaccatagtgactgtactactttccattcccacccaccgcatatacgagttcccttttctccccttccttgcctgagctgggcctttctgatcatctgtccccgtcccttgaactcttgatctggactgagggaagaatggtggcagaggcgagctggggagcagggaggaaccaggctgtcgcaggagaaacagaatattgcgagccagccgtgtggaatggaaaggggaagctggtcttcctgccccacactcctgcctttcttccttaagggctccttggacagagactgcaggtttctcagaagcactgtccaggatctcaacattctagaagggtctaggacaaactaactaactattgagcccctccagtgcttttgttgtttttgttttttgttttttgttttttgagacagagtctcactctgtcacccacgctggagtgcagtggcgtgatctcagctcactgcaacctccgcctgggttcaagtgattctcctgcctcagcctcccgagtagctgggattacaggtacccgccaccatgcccagctaattttaaaaatatttttagtagagatggggtttcgccatgttggccaggcttgtttcaaattcctgacctcaagtgatccgcccaccttggcctccaaaagtgctgagattacaggcatgagccaccccacctggcctccatttgactcactcatcaaaaatttaatcttggcagggtgtggtggctcacgcctataatcccaatactttgggaggccatggcgggtggatcacttgaggtcaggagttcaagaccagccaggccaacatggtgaaaccctatctctactaaaaacacaccaaaaaaaaaaaaaaaaaaattgaactgggcatggtggcacacgcctgaaatcccagctactggggaggctgaggcaggagaattgcttgaagccgggagacagaggatgcagtgagccaagattgtgccactgcactccagcctggacaacagagtgagactctgtctcaaaaaaaaaatatgaatctcccatggcaccacactgaagagtctgatcttgcttttacagaagaggaaaccaaggctcagagaggcacacagtcgggattcagaaccagtcccacttgactccaaagcccaggctcttttctccaatacttttcatgtcgcctcttttctctgaaatgtccatttcctcattctgtccttggttaagcagcagctgttggcgggtgctctgtccaggcctccgctaccatgacgagccttggcaaagcctgccccactgccagtttgctttgccacgtctgtgtcaggaaagctcaatcaatctctcccgattacagatcagaaagggccaaataaactctcaacccaagccagattctgtccctgaagatgcagtaagggggtctcggtacccacagaacatcccaccacagaaagccaggctccagcctgaaagtccatcttccctgctctagcccacccgtgcgatgaagagcacagaagaggcgggtgaaggcattgcatcttcagcatcggcttggagaatgacaccctgcaggttccacttcttcccaggccacctgcttgcttctggaaagcagggaacaggcaatccggggagagaggagccagccacacaaggactgggaagcccagacctgtgccatcagcctgcgatgacttaggctggggatccgaaaaggtttctatgaacagccagctggtaagtaatttagactttgaggcccatacagtccttgatcaccgccattcaactctgttgttatagcacaaaagccacgtgggtttggccttaccagtgggcgtggctgtgttccaataaaactttatttgcactaggccaggcaccgtggcacaagcctgtaatcccagtactttgggaggccgaggcgggcagatcacctgaggttgggagttccagaccagcctggccaacatagtgaaaccctgtctctactaaaaatacaaaaattagccgggtgtggtggcaaaaagaaaaaaaaatatttacaacaacaggccatcagcccagcagtgggtctagtttgccaaccgctggaaaaagccaacaacattttgggaggccgactgccggctacaggacctcgccataccaacaagggctgagacccgcggctctgcagggctctaacaacagcgtttgacctgagtctatctggggaaacatcacgtgaacccacgttgaggccctactctggaagctgcaaaattagagatgatggctgtgcggctctgtgaatgtactcaaaccgctgaactgtgcactttagaggagtgacctcatggtatgtgaattacatctcaataaagcagctcaaaagcaggctgggtgcagtggttcacgcttgtaatcccagtgctttgggaggccgaggtgggaagacggcttgagcccaggcgttcaagaccagactgggcaacgtggcaaaacctcgtctcgacaaaaaatgtaaaaattagctgggtgtgctggtatggtcccatagttccagctacttgagaagctgaggtaggaggactgcttaagcccaggaggctgaggctgcagtgagccatgatcatgccactttactccagcctgggtgacagagcaagaacctgtctcagaaaaacaacaacaaaaaaaaacaaaaaacataggccgggcacagtggctcacacctgtaatcccagctactctggaggctgaggcaggagaattgcttaaacccaggaggcggaggttgcagcgaaccaagattgcaccactgcactccagcctgggccacggagcgaaactctgtctcggggaaaaaaaaaaaaaaaaaaaaattctaggcaatggatacaatcaggatgatttttcttgctttttgcttaagtgtcttttccatgattaacacatatagttgtgtaattattttaaagttagaaggcatttgggacgtgaatggagagacagagaagttttctttatgatggagagaggcggaagggacggcttcctctgcgagggtgcaagggctgacctgggagagcaggcagctgcgactaacgctggctggggcctgcctgacttccccttgagtcctcagaggcacaggttataacccaatgttttattgcttcttgagaacattattggcattcatctgccttcgaaattttggctattcatttatttatttatttatttatttatttatttatttgagatggagtctcgctctgtctcccaggctggatggagtacggtggcccgatctcggctcactgcaacctccacctcctgggttcaagtgattctcctgcctcagcctcttgaatagctgggattacaggcacccgccaccatgcccggctaatttttgtatttttagtagagatggggtttcatgatgttggccaggctggtctcgaactcctgacctcaggtgatccacccaccttggcctcccaaagcactgggattacagggatgagctactgcacccagccaagctgttttttttttctttatagacagagtcttgctctgtcccccaggctggtacaaccatagctcactgcagcctcaaactcctgggctccagtgatcctctcacttcagcctcccgagtaggtgggactacaggcacgtgccaccacccctggctaatttttaaaattttaatttattttatgtagagatgaggtcttgctatgttgcctaggctgatctggaactcctgggctcaagtgatcctcccgcctcagcctcccaaagtgctgggattacaggtgtaagccaccgcgcctggccagtctgggctttttctttttttttttttgagacggagtcttgctctgttgcccaggctggcatgcagtggcacgatctcggctcactgcaacctccgcctcccgggttcaagtgattctcctgcctcagcctactgagtagctgggattacaggtgcccgccaccacgcccagctaatttttgtatttttagtagagatggggtttcatgatgttggccaggctggtctcaaactcctgacctcaggtgatccacccacctcagcctcccaaagtgctgggattacaggcgtgagtcactgcaaccggcccagtctgggcttttgaaagtactgtgctctgaacatttttctaggtcataaacacaaatctgtaatatcatttgaaatgtctgctcactctgttgcggcagggagaaagattaattgatttagcttatctccagcagacaggcaaacctcatgaacaaggccagcctcaggagctcctctccctcctcagtggctccatccgtcacctgtagagcttcagcccagctccacagcctagaccattcatccccaagccagtatcagtctgaatcagcaccattctgttgatgtacctccttttaaaagccgtctctctctctttttttcttctttttttttttgagacagagtctcactctgtcacccaggcaggagtgcagtggtgcgatgtcggctcactgcaacctctgcttcccaggttcaagcgattctcatgcctcagcctcccgagtagctgggattacaggcgtgcaccaccacgcccagctaatttttttatttttagtagacatggagtttcaccatgttggcaaggctggtcttgaactcccgacctcaggcgatccacatgcctcggcctccccaagtgctgggattccaggcatgattccaccgtgcccggcctaaaaaccatctcttcttttactctgctatttcctagccagctaaccctgagcaggttccttagtgggcctgtgcctccgttggatcgtctgtacaatggggatgaggatagggaaggaaatgggttgacactagtgaagagcaagaacatacctccaagcccttggcacctctgccagctgttattgttgccatagtcattatcaccatgtcatgattcacctccctggctgctcccaggcctccctcagggcggggtggggaggaacaagaacacaaagacagggagagccagggtttgatgcagaaagagctggtgtcccccactagctccgagagcttcctgggaggcaggaaattcgcctctcctttttggaggtgtggaagtgggggcagagagaggccacctgtcccggatcgctctgctggactcaatctggggccagcatttgacccccgctcaccctgtttgctatgaatgtcagttcccctcgctactgctggctcccttccccctcaatgctccgtttcctgttccctccaaggccccgttacacaatttccactgtctgctgaagttctagctcaaatccctctcgccgagactttctggtcaccagattccagcagaactcaacagagacctctacccgcctgagctcctgaccaggttagagggcatctggctcccaggcactgggtcaagctccagaggcatctcctgtgtctgcccgcgacccatggccccgctcagggcctgccttccatctcctgggtcttccccagtgcaggtgggagctctgctcccctggtaactgcgagcctctcaacaccaccttcctcctcagtgtcatccccctcctgtctgccccctctcccccagtgcaggggccataaagccttccccggagtcccactgccaggtcccactgccgggcctccaggctttgctgctccacctgggctcaagcctggccatactttgttctaatgactctgtccccctgtggtacactctctaccacagccaccctgggctccccatacccaccccaggacctttcctcggggcttatcttagctctgataagatccacccctcagggcccacaatctcaacagtgtcctaacctcggtaagagtctctagcaagaggtgcagcctgcaagatgatcttcgcattcctgcgctcacttccttgaagatgggcaccatggctttggagtttgagaccagcctggccgacagggtgaaaccccgtctctactaaaaatacaaaaaattagccgggcgtagtggcgggcgcctgtagtcccagctacttgggaggctgaggcaggagaatggcgtgaacccaggaggcggagcttgcagtgagccgagatcccgccactgcactccagcctgggcgacagagcgagactccgtctcaaaaaaaaaaaaaaaaaaaaatacaaaaattagctgggcatggcagcacacacctgtaatcccagctactcgggaggctgaggcaggagaattgcttgaacccgggaggcggaggttgcagtgagccaagatcgcaccactgcattccagcctgggcgacagagcaaaactccgtctcagaaaactaaataattccttgacacacttgccatagtatttctgtgtacggtaggcacccaaattctattgtaaaacaaaatataaaaacacttaagtgaataaattctgtaagaagcaggtatctaagacatagacaccaggcccttcctaactggtgaggtctggagttccctcaggccatgtgtggtccagctgtgatcagagtttgagatcaaagagcagctgccgtctaccaaggacgtcttccccatggaagacaaccacagaacctcccaggtctttggagccatccctgagaccagctaggaggccaaaggacactgatggcatcctttccccagagctggttacaggtctgcctcggactcccctcgtggtggtagtgtctgagcggatcctggctgcccagggcggccgagtgcagaatgagggtggaagaggagagaaaggcaagatcgttaccatcgctcagctccgagactaggcagatactcacaagaaacagaagactcgaaacctataaaaagactccttttaaatggcagtgacttgacgtttggagggccacaggcacctttgagaagttggcggctgccactgtccacaaaaaaaacacgtacgcgtgcacacacaaacacacacacacacacacacacacacacacacacaacttcacttacagtttccgggcttgtgaccacccccaaacccgccaggcctatctctggctgggtgttcacacactctgggttaggacccctcttttataaagactgttcctcaatttgcttcttagcgtaaacacactctcaacctgacttgctggggctccggaagctttccctgggctccagtctgacctggctgactggggagtagctcagccctcagttgtaaggtgggaatcatcggggcggggtctctgtgcccttccctctgccgctgcacagccacgtcccagcaaatgcacgagggcaccagggcgtcagggcacaggctgcaggggtccaggcaggtgggccctgggaggtcctggggacaccagcttcatcctgcctgccactctgagacatccatgctcctgaccatctctccattgggaagtctgggtctgcccgccttccctcctcccagcaatctcagggcagctcatctgcctgcttactccaccccccgacactgaggtggtcagcctccacactttctgttcagacccacgggcaacaaaaacaaaaccttggccaagcactcacaatatcagatattcattaaaaaagtatatataggccgggcaccgtggctcacatctgtaatcccagcactttgggaggccaaggtgggcagatcacttgagctcaggagttcgagaccagcctgggcaacatggcgaaaccccatctctacaaaaaattaaaaaaattagctgggcgtggtggctgcttgggagactgaggtgggagaatcgcttgggccaggaaattgaagctgcagtgatctgtgattgcaccactgcactccagcctgggtgacacagcaagactccgtctcaaaaaaaaaaaaaaaaattatatttggagtacaactctgaatccatatgctaactattcataacattcttagcaccgaggctgtactgggcacccctccggagacgactggtctatgccaactttggcgggcggcagcagcacctggagagtcctgaaactccagtgccacccccaggcccgctccagcacgcggagttaggcggctgccttctaccaggctccctgggcaacgcccgctgtcattccacagccagaacatctttggtggctgcgtgggtcccgggatggaatgcagatgtcacatgacaagccagagccgtgacatttggccccaatctccttgtgggtccccctgaatccccaggctcctctttggcctactctgtacccagaactctcacctttcctggggcagttggtcccttggcttagaacacctgtgcacaccccaccctgctgccgctaaatgaccaggggttacggtccccagtgccgtcctccagatgcggcttcttcaccctcccttaccttgatttcttcactctgccctcccctcttgaaaaagaccatctgctgggtgcggtggctcaagcctgtaatctcaacactttgggaggccgaggtgggcggatcacgaggtcaggagatcgagaccatcccggctaacacggtgaaaccccgtctctaataaaaattcaaaaaaattagccgggcatggtggcgggcacctgtagtcccagctactcgggaggctgaggcaggagaatggcgtgaacccgggaggcggagcttgcagtgagccaagatagcgccactgcactccagcctggagacagagtgagactccatctcgaaaaaaaagaaaaagaaaagaagaccatcctagccatgcagccacttgccctccgtccctggtttgtgagcctgtgcgtgcaccgggggacagagagagtgtccagggcatgcacccctcctgcccctgccactgccacgtctgcctgtctttgcttccttcttatctcctcctccctgctgttgcatccctcctcgcagctgcctgggaagcctcgggcagacctctttgttgtttccgaacccaagacgttcacccctacacacgacccccactgcatcgagtcagtggttctgcatcaggactggagacggctgcccgcgcctctcagtctcccaggagtcatctatgccctgttctccatgtgctcagatgtcgccacagagtctgaacctctcagcccacaccagtggcatctacctagcaacctggctgcgacagcagggaggagggaggcagtacccaagcccacctgcagctcacaaacgacaggccaggactgcgtacgtggctctgcacccccagaagggtgcaaataggggaggcccgagaggctctgaggctggcactgtcctcagatcccagatagggagaaacgtgtgttgtccagagagctccttccagcacctgccatacctccaggctgtgcacagctctccctgctcttccagtccccctgccttgggagctgccagtaattcaggggtcagtgactcccctgacagatcctgtccctccaaggacgctgttcaaaaccaagccgaagagcctcagttctccccacagctccctcctcaacctaccatggggccttctatcctcacatcttgcaaatgcatttcacattgtcacatgattactcctgaattttggttatttcgaaagtttatctgttgttaattatttaccgaaaccacactgagtggactgactttataccacacctgggcagttgaggaggggaggcctgctcaccacgccgggcagcaggaacccccttccacaccgcctggtgccaagatgtaccaccccctgcatcccccaccacagggacaatgtcttgcttctcccttacatccccgggggcagaggcagccactccataattgcttgttgaaacacagacaagcccaatatgaaaatcaagatgaacaaaactgacaatacagatcgatcacatacttcgcacaacgagttgccaacagtttctttaaaaagcgccacgccgccccctcgcatggaaggcctgacccagctcacatgaatctgatgctgtgttgcttttcctgagcacgtgtcctgaagacagagccatttttgactgcgtgctgtgtgttttctggggtggcccctactatctgtctggtccctgtcactgtgtcccccaggaaccaggtcacccttggctgttcaccccagaaaatagcagttgttccccctcttggttgtggacccctctctagctggagctggagctcctcgggggatttgcagaggacagtttctggaggtgggaacatgtgaggaagatgtcatcgcagaggtcttctaggataatgtgtggccttaggtactgccacccaagccagaggagaggttttattctctgcatccagagagctcctggctttacccttgagtccagaaacgggcccaagcagcccgagtctgccaagtagctcagctggctaagtggctccaggcatgggactgcctgaatggtgagcccaaagctaatttccagccagatccctgtagctgtgcaggctggcagtagatgtgaaggatttcactgggtgagagggagccgggccagcagcgcatttgaacagtactgtaactgagacacaaaatgcttcccgtttgtgctggccttgctggaaaggacaaggacctggggccttccaggaagaaatcaggtcacctcttaccatcccttatcctaaacatcaccacctcatcatgaattatctttgccgaccacagttccggtcctaccaactgcaagagctgctagggagatacctcccagaaatcctcagccgggcagacagaaatctgactgtttcttaagccaattgcctcttgtagacaccaagccatttaacaaggctgcatgcagccaagagtaaaaggagccagcttgccacataacaagccagcctttattaacctccactgtaccccctttctgagacccctgggtcacagccctggttaaatcacctgtgggccttttaaaactgcaaaagccgaagtctgagcaagaccctctgtatctgcaaagggacctagacctgagcaatctttaagaatcttccaggcaattctgctctgagccagaatggggaaccattgctgagaaagtcacaaacctgcatcgcttcgaggagaatcgaacactggagaatagacaggccgctgtcgtccctgtgggatttgttccgggaccctaccctgggatgtcctgggttgtttatcccaagttggttgagcacggaaagggtgactgggaataagagaaggcagcctggtgtatgggctgaattacgtcccccctcaaatgcacatctagtcagatcctatgaatatgaccttatttggaaatagagtatttgttgatctatcaagatgaagtcatactggattagggtgggccctaaatccaatggctgctgtccttagaagaacagggcaatttggccgggcgcggtggctcacgcctataatcccagcactttgggaggctgaggcaggcggatcacctgaggccaggagttcgagaccagcctggccaacatggcgaattcctgtctctactaaaaatacaaaaaattagccgggtgtggtggcaggtgcctgtaaccccagctacttgggaggctgaggcaggagaattgctcgaacccaggaggcggaggctgcagcgagccgagattgcgccattgcactccagcctgctctccaaaaaaaaagaacagggaaatttggacacagagacacacgagagaaggccatgtgaagacaggcggaaatggaagtgatgtgttccttgaaaatggaaccaagcaacatcaaggagagaggcctggaagagattctccctcacagcccccagaaggaactggctctgtggacaccttttcagacttctggcctcctgagctacagagaatcgattcctgttcttttaagccctcccatttgtggtagtttgtcacagcggccacaggaagcgaatgccctgagctctgcagtgcaactctggcatctgactgggcctctgagccgggatggggtgaaaagttttagctacaggatgattttgatgcaaagatttagacacaaatgccaggcaacccagaagaggagagtgctgcgctgagcatgaaggaggcgggaggcacgcactgcagccctccaccctctgccatcctggatccacaccccacgcagaaacagctcccagctcagtggccgccttaacttatgccaagcaaggacagagtggctgcctggacattctcccacacagctgaggagtgtgtgtgtggggcggggtgggggggggggcgggagggggaggggtcccaaggcccaactcctacaaatccaactcccaggtccttttatccacagcctccttctgggccttggctacatcctgccccagcacgtgctggtgagccaaggagcctggacaggcctgcactcctcgtggacccccagagaaaggcccattatggctccctcatcaaaggaacctctccttcacccacaaatcttgctgagcaccaaggctaaactggagaaaagacctcatttcccccaaactgggttttgtggaaactgacacaggcacacaccaagccttccgcccaggtggcctgagccacctgagacctgtgatctcaatagattggtgcaactgaaaacttccccagctgggcacgcagctcctagggctaaccggggtggggcaagaagccgtgggcggggtatgggaagggcgtggctgacagcaggagaaacagaaagtcccacctccactctgggcaggtgagggggcccccgccttgctccatctgccctggacaggtcactcgactgagactcagacataagaaggaaggagggcagggggctccgagaccacctgccgtgtagccagacttgccccaggaaaaccatgctgaccagcaccagggctgcagaggcttgaggtgcaggaccagggtggaaacttcgagccagcgggttcctcccatttctgctggtcctccccctccatggatcagaacaaataactgggcccctcctgcctccctccatggcgcctgtcttttgggggctaggagtccggaggtcatgggtatttgctggggaatctgagcagcagcacagtcccacgtgccgggtccggtcaccaaagtctccagcttttgtggacgtcccgaaaaagcggaacattcgggggtcccggtccctgcccagccagtttgcagggcctcctgggcagggcgcaagcaaggagccacgccaggagacgccaccggctttttcacctgcccctctgggcctgtggaacctgcctcgggtagggcgggcttccatcccaccctggcttgatcggggagcccccaaatggggctggtgggagaagccccagcagagaagcccttccccacccagccccaagcccagagaagcccaactcccaccttatctgcgaaagtttcttcctggggtccccagtcctccagccccccgcccccacgccgtgtcccccacgctccccgcccccagcgctggcatcccagggcgcgccgcctgccaaaagccaaactggctccctttcctggggctggagctgcggcggaatttcggtggaattttgaggttgagacgcatctcggcaaagagagggaaagaaagggagaggagggaggggggaaagaaagtcggctctgggcgtccacttgcaggattcgagaaggcgccgagggaccaggaggcgggcgctggggtccctcggccagcggcgggcgggcggggcgtctgcgaaccctcggggtcgcgggggaggtggggccccgcgcgggggctggggtcgccgctccttacctacatctgcattgcaaaacgcctgttgcgggtgcaccggggagcagctgcaggcgtcggccgggcgaagcagcgtcgccagcagcaggaggccgagcgccagccgcagggtgcgggccgcggcgcccatggcgggccggggggctgggcgggcgggggccgccgctggggggtccgggcgctgctcgcggcggcgggctgggggcgcgggcgggggctgagccggggccgaggcgggcccctcccgcgcggctcaccctcctcacctgccccgctcggccgcgcaaactttctctcctctttgtctcgggggcgcgaggggaggggcgcggggcgcaattcgccgggcggggcggcggggtggggggcggcgggcgagcggcgctgcggttctcggcggccgcgctgccttctacggatgtgtttgctgcg

SEQ ID NO: 170 - DNA, 14197 bp, Homo sapiens
gctcacgtgacaaagctcccggaggtgggagccctgggccaaaatggcggcctacctgcagtggcggcgcttcgttttcttcgacaaggagctggtgaaggagccgctgagcaatgatggggccgctcccggggccacacctgcttctggatccgctgcttccaagttcctttgcctccctcctggcatcactgtctgcgactcaggccgagggagcctggtctttggagatatccttcgtttggagctgtcttttccctcccgggatcccgaagagatcgagttaggatgaaatctgtttgtcggaggggtccgtgccgcgcgcctctttggtttagctggtcatccagagttgttctgtggtctacgggaagaaagaaggaagtccatctcctaacttgttatcaactgagcaatcctgggcaagtcatttaacctctctgggttttaatttccttatctgtaggagatgtgtgcatgccaatttgacgaggttaatttgagatcaataagaaaaagaatgcaagttggctttaaaagatgaatatgtaaagtgacatgatttcccctgccctaatattatcgttggcgaggaggtaaatgagcctagcggtttgttgctttcatcttcatgttgctgctactaaattctggcctttttacctttttttttttttttttttttttgatacggagtcttactctgttgcccaggctggagtgcagtggcgggatctgggctcactgtaaccgtctcttgagttcaagcgattctcctgccacagcctcccgagtagctgggactacaggcgcttgccaccacacccggctaattttttacattttcagtagagacggggtttcaccatattggccaggctggtctcgaactcctgacctcgtgatccacccgcctcggcctcccaaagtgctgggattacaggagtgagccatcgcgcccggcgcactaaatttttttcttttttttgagacggactttcactcttgttgcacaggctggagtgcaatggcatgatctgggcacactgcaacctccgcctcccgggttcaagcaattctcctgcctcaacctcctgagtagctgaaattacaggcacgcaccattatacctggctaatttttgtatttttagtagagacaggtttcaccatgttggccaggctggtctcgaacccctgacctcaggtgatccgcacccccccccccccccggcctcccaaagtgctgggattacaggtgtgagtcaccgcgcctggcctcattctttttaagataaggagtatgtgggaaaatccttgaaaattttagagttatatacatgtaattgttatctgagttctggtctgaatgtaagtatctctccttggaaaggaggctccttgactaccctgcacatatggaaggccagatctggttcttgccacgttcctacagcttacaggcttccaagcctacaaactacgggtgacacacctgtaccaactgaagcagcacaatattctggcatctgttggagaagatgaagagggcatcaaccccttggtgagtcccagcagggaaatgggaaagatccagaagcctaggaatgattttttgttggaggatgactagcatttacacttctgaggtctgtccacaggttaagatctggaacctggagaagagagatggtggcaatccactctgcactcgaatcttccctgctattccaggaacagagccaactgttgtatcttgtttgactgtccatgaaaatctcaactttatggccattggtaaacagaaggcaaaactaaccctcctagatttgttatagattttcttcagagttgcttctgcctctcatctttactgttttcaggagaccactttgtactgaactgaggcctttgcgatattaaattttggaatgggggccaggcgcggtggctcatgcctgtaatcccagcaccttgggaggctgaggtgggcggatcacctgagattgggagtttgagatcagcctgaccaacatggagaaaccccatctctactaaaaatacaaaattagttgggtgtagtggcacatgcctgtaatcccagctactagggaggctgcggcaggaaaatcacttgaacctgggaggcggagtttgcagtgagccaagatcgcgccattgcactgtagcctgggcaacaagagcaaaactctgtctcaaaataaataaataaataaataaataaataaaataaataaagtttggaatgggaaggcatttaattttgttctttgaaaatgtgtcagtgagtaccaatattcaggttaaccattagagaggttgggtatatggagaaagcttgtcacttctgagtgcctcaagtggtcttttttcccctctccacttcctgatcttttcagccttactgaagtaattttcttgttttcttacaggtttcacagatggcagtgttacattgaacaaaggagacatcacccgggaccggcatagcaagacccagattttgcacaagggcaactatcctgtaactggattggcctttcgccaagcaggaaagaccactcacttgtttgttgtgacaacagagaacgtccaggtatgaccaaggcctccactcttaggagcaggcagggagggcttctccattgttcagggggatagggtaatgaagtgacaggaaaggtgggagtgttaaagttttaatcatataattcgaatcatttgcctagctttgtattttatttttttgcctaggaagctggaaagagttagactctgggcttgtagtaaaaagatgtgaattttctttcttttttttttttgagaccgagtctcactgtgttgctcaggctggagtgcagtggcgagatcttgactcactgtaacctcagtctcccaggttcaagcaattctcctgcctcagcctcctgagtagctgggattacaggcacacaccagcatgtccagctaatttttgtatttttagtagagacagggtttcaccatgttggccagtctggtctccaactcctgacctcaggtgatccacccaccttggccttccaaagtgctgagattacaggcgtgagccaccgcactcggccttgaattttatttctaactagctttttttttttttttctttgagacaggatcttgctgtgtaacccaggctagagtgcaatggtgctgtctcagctcactgcaacctctgcctcctgggctcaagtgatcctcccacctcagcctcctgagtacgtgggattacaggcatgtgtcaccatgcctggctaatttttgtattttttctagatatgggggtttcaccatgttgcccaggctgatctcgaactcctgggcccaagcaatccacctgcctcaaccacccaaagtgctggaattacaggcatgagccactgcaccggcctattttctaactaactttttaaatgacgttggacaagtatctttacctttcttgttcctggtgccccagatttacaacagtctactctctcaggaatactcttgataaagtagtagattattacatttttcttacttgcagaatttctgtactagatagtgataatatatacagagaaagaaattgtgatctctggttatatatttaatagatgggtaatggttaatgaagaaggccagcagccaagagaaagactttagaatgccaagagggaaaaaagagccagtatggagatgggaatacctttgtgaaggcttagagttacctcctcaaaggagcctgttaacccctttgttgcttctggcagtcctatatagtttctggaaaagactaccctcgcgtggagttggacacccatggttgtggcctgcgctgctcagccctaagtgacccttctcaggacctgcagttcattgtggccggggatgagtgtgtctacttgtaccagcctgatgaacgtgggccctgcttcgcctttgagggccataagctcattgcccactggtttagaggctaccttatcattgtctcccgtgaccggaaggtttctcccaagtaaggactcagtgagaagggacagggagagggctggacttgttccccagaatccgcctgattttaaaatcctaatgcctggatactgccaatctcctactcctactccggtgttatgtaggtaacatttctgttttttttttttgagatggagtctcgctctgtcacccaggagtgcagtggcgtgatctcggctcactgcagcctcgcctcctgggttccagtgatactcctgcctcagcctcctgaatagctgggattacaggcatgtgccaccacgcctggctactttttgtattttcagtagagacgaggtttcaccatgttggccaggctggtgtcagactcctgacctcaagtgatctacccgcctcggcctcccaaagtactgggattacaggtgtgagccactgcacccagccagtgacacttatagctagagttggttacaatgctttttttaactgaaaaatggatgtttttactgcaggtatttgctacatagccctagcatactagaatgctccagggaatttggacctgctttttttgttctgttttgtttgagatggagtctcgctctattgcccaggctggagtgcagtggcgcgatctcggctcactgcaagctccgcctcccgggttcacgccattctcctgcctcagcctcccgagcaactgggactacaggtgcccgcccccatgcccggctaattttttgtatttttattagagacggggtttcaccgtgttagccaggatggtctcgatctcctgacctcgtgatctgcctgcctcgtcctcccaaagtgctgggattacaggcgtgagccactgcgcccggccttgttttgttttttaactcttttgtcaaaataaattgggcagaggaacaagggattcagcagtggagaaattagaaagtgctgggaaacgtaggatgcaagttttctgttttgttttggttttatttttttaaggggtaagtggggtcttctgcatgatgaaagtactccctgttagatgctggtttgttttgctttcattcagttccaggcacagtgttttacatataccatgtattggattattattttctaaatgaatggatatgttagtgtacttaattttctaatctgttacttgggttaattgtaggatcctaaagggtaagatcaggtttatgtgttctctatgtacaactaccggcacagcgctgcatgttatgggatgagagggaccagagaggtgatttgtgctgggtgaaatgtgcaccaaagttatcatgggaaaggaaataggggagataagacagagatgtccaaacatctggtgctttttctttcctatgcaggtcagagtttaccagcagggattcacagagctccgacaagcagattctaaacatctatgacctgtgcaacaagttcatagcctatagcaccgtctttgaggatgtagtggatgtgcttgctgagtggggctccctgtacgtgctgacgcgggatgggcgggtccacgcactgcaggagaaggacacacagaccaaactggaggcaaggccaccaggctcgcagagctggccacaggcacctagaagcagctgcaggagcaggttccccaagtcatattggccagggtgtttccctccttgtgggtcacagccttactcagcttccttagggtaggattataaggtaaatggcctgggatggggctttagagggaagtagtggctgggagcctgagcccactctaagggttcactttgtttccagagaaccttatgaaataagatgatactgatcttggggatatctggtagctcttggtttgtctaggatctaggcagatcagaaatccaggactttctgttttgtgtgttgtgcgcacattttgggaaagtgtcttcccaggaccacttctaccaattttctaatctctcttcccttctagatgctgtttaagaagaacctatttgagatggcgattaaccttgccaagagccagcatctggacagtgatgggctggcccagattttcatgcagtatggagaccatctctacagcaagggcaaccacgatggggctgtccagcaatatatccggtcagtctggaggcactttgggatatagctgtgaatgcagggacaggcagctagatagctaaagcccatccatgctccaggtaggggctagaattctaccaggaactgtttttgtttttggttttttgtttgtttttgttagtttttttttgagatggagtttcgctcttgttgtccaagctggagtgcaatggcgcgatctcgacttactgcaaccttccctcctgggttcacatgattctcctgcttcagtctcccgagtagctgggattacaggcgcgtgccaccacacctggctaattttttgtatttttagtagaaacggggtttcaccatgttagccaggctggtcatgaactcctgacctcaggtgatctgcccgcttcagcctcccaaagtgctgggattacaggcatgagccactgcgcccggtgtttttttctttgctttttttgtttgtttgtttgtttttgagacagattctcgctctttcacccaggctggagtgcaatggtgtgatctcggctcactgcaacctctgcctcgggttcaagcaattctcctgtctcagcctcccaagtagctgggattacaggatcatgctgccatgcctggctaattttttgtatttttagtagagacggggtttcaccacgttctctaggctggtctcgaactcctgagctcaggcaatctgcctgcctcggcctcccaaagtgttaggattacaggtgtgagccacagtgcctggcctttttaattttctttataagaactatgatgccttaaatgagagaacaagattccttgttgaaaagggaattttagggtcaaatattatatgaccagtatgcagttgagccgatgattacctctcattttaacctttagcttggcctttgtaaatattcactttgacctggttctttaagggggaaaaggtattcatctcttgcttccataattccttccatcagtactaattcttggaattttctgccttaagaaggggttttagaaatctgtctaaggtggccgggcgcggtagctcacgcatgtaatcccagcactttgggaggctgaggcgggtggatcacgaggtcaggagatcgagaccatcctggctaacacggtgaaaccccgtctctactaaaaaatacaaaaaattagctgggtgtcgtggcgggcgcctgtagtcccagctacttgggaggctgaggcaggagaatggcctgaaccccagaggcggagcttgcagtgagccgagatcgcaccactgcactccagcctgggtatcagagcaggactgtctcaaaaaaaaaaagtttgtctaaggctggggtgcagtggcatgtgcctgtgatcctatccctttgggagaccgaggtgggaggaatgcatgagcccagtctgagcaacatagcaagaccccatttctaacaataaataaataaataaaatttaaaaatatggctgggcgccgtggctcattcctgtaatcccagcactttgggaggccaaggcgggtggatcacttgaggttaggagtttgagaccagcctggccaacatggtgaaaccctgtctccactaaaaaaaaaaaaaaaaaaaaaatacaaggccaggcgtggtggctcacgcctgtaatctcagcactttgggaggctgaggcaggtggatcacctgaggtcaagagttcaagaccagcctggccaacatggcgaaaccccatctctactaaaaatacaaaaattagctgggcatggtggcgggcgcctgtaatcccatcttaaaaaaaaaaattagctgggtgtggtggcatatgcctgtaatcccagccactcgcaaagctgaggcaggagattcacttgaacctgggaagcagaggctatagtgagccaagatcgtgccactgcactccagcctgggcaacagagcaagactctatcaaaaaaataatagtagataataataataataataaataaataaattgccagggggcagtgactcacgcctgtaatccaaacactttgggaggctgaggtgggcggatcacgaggtcaagagattgagaccatcctggccaacatggtgaaaccccgtttctactaaaaatacaaaaattagctgggtgtggtggcatgcacctgtagtcccagctactcgggaggctgaggcaggagaatagcttgaacccaggaggcggaggttgcagtgagccaagatcgtgccctgcactccagcctggcgaaatagcgaaacttcgtctcaaaaaaataataataaaaaaaggccgggtgtggtggctcacacctgtaatcccagcactttgggaggctgaggtgagtggatcacctgaggtcgggagttcgaaactagcctgaccaacatggagaaaccctgcctctactaaaaatacaaaactagctgggcatggtggcacatgcctgtaatcccagctactcaggaggctgaggcagaagaatcgcttgatcctgggaggcagaggttgcggtgggctgagatcgtgccactgcactccagcctgggcaacaggagcgaacctccctctcaaaaaaaaaaaaattaattaaattttaaaataatgtaaaagaaagagaacaaaaatacaacaataaaacaacaacaaaatagtaataatataaaaagaaacctgtttggcctcttccccgttctctttagaattcctatttttagccaaatttaagaagcagtgctctggagccttgttacccagtgtggtccacagtctagtagcaccgatattacctgggactttgttagaaatgtagaatctcaggccccactccagatccactgaaatagaatttgcattttgagaagatctgcaagtgattcctgtgtacatgagctggagaagtacactgattcagatgctatcgggtgcacatgtctccctagaaccattggaaagttggagccatcctacgtgatccgcaagtttctggatgcccagcgcattcacaacctgactgcctacctgcagaccctgcaccgacaatccctggccaatgccgaccataccaccctgctcctcaactgctataccaagctcaaggacagctcgaagctggaggagttcatcaaggtgcaggatgttgttggtggggaagtcttggaggccccactgagcatgaggtggctccaccgggacttgttcgtttcagcaagacatagggagaggaaagggctgaccttatttagaggagtggctgttcctgttagttcggtgccatctcccctcttgttttatgattctagaaattcccatggtatctaagcccagggtggtggcactggggaagtcctgtccctagcggtgtccctctaatggtaggggcagaggaaaactttagtcagaaactcccacaggctgagtagcataatattttcaaagtgtgaacgttatgatatcaccttaggaatctgaaagtcaggtgcctgtttcctctcccttctctatctccctctgtgtaaatgattttgtctcatgtctccctggcagaaaaagagtgagagtgaagtccactttgatgtggagacagccatcaaggtcctccggcaggctggctactactcccatgccctgtatctggcggagaaccatgcacatcatgagtggtacctgaagatccagctagaagacattaaggtaggtgagactgtcttttttccccaagagacagggtctcactatgttgcccaggctggagttgaattcctgggctcaggtgatcctcccaccccatcctcctgagtggaggtgagactctcaacttgggcagagccctgtcgtttttgaagacatctccagaatggtgaaagtgcttcctggtggctgaggcaggagtatacactattctgccctttacttttccacagaattatcaggaagcccttcgatacatcggcaagctgccttttgagcaggcagagagcaacatgaagcgctacggcaagatcctcatgcaccacataccagagcagacaactcagttgctgaagggactttgtactgattatcggcccagcctcgaaggccgcagcgatagggaggccccaggctgcagggtgaggctgcagggaaaagagcttcagactgtggggatcaccttaagggcttcctgtatatcacgcccactcattcagcctcctttttcctctcttgccatcctaggccaactctgaggagttcatccccatctttgccaataacccgcgagagctgaaagccttcctagagcacatgagtgaagtgcagccagactcaccccaggggatctacgacacactccttgagctgcgactgcagaactgggcccacgagaaggatccacaggtgaggcctggccagggcttcaggagaaaagacagttcgtgccgtctccattcttccgtcttggtggctgcctttcactgcattccttagaccagtaacaccttacctcggggctcaatggtcctctgtgaagagggaatggactgagggaaagagttgactggctttgtcccaagagaccttgtgattttccccttttgtccagcagctctgccctccttcctctccaggtcaaagagaagcttcacgcagaggccatttccctgctgaagagtggtcgcttctgcgacgtctttgacaaggccctggtcctgtgccagatgcacgacttccaggatggtgtcctttacctttatgagcaggggaagctgtaagagtttggggaatttcagggaaaggggaagaatccaagtcattttccagagacagccactgaggtgtgcccttgccccggccgcaggttccagcagatcatgcactaccacatgcagcacgagcagtaccggcaggtcatcagcgtgtgtgagcgccatggggagcaggacccctccttgtgggagcaggccctcagctacttcgctcgcaaggaggaggactgcaaggagtatgtggcagctgtcctcaagcatatcgagaacaagaacctcatgccacctcttctaggtacttgggaagacagatgggtgggtgacaagctgctgacagctgggctctgtggcaggggcccttcacctttatccagagagtgccacacgtggttgattgtcttgtttcctcttggaccccaatctcagtggtgcagaccctggcccacaactccacagccacactctccgtcatcagggactacctggtccaaaaactacagaaacagagccagcagattgcacaggatgagctgcgggtgcggcggtaccgagaggagaccacccgtatccgccaggagatccaagagctcaaggccaggtacccggggcatggatatgtggaggagtccaggggataacttgcccttcacagggtattcattactaagtactttccgtagaggatactatggagtgcttttgagcattttgattcttcaagttgtgttttaattgaggaattccaaaaaatggtttattacatagatcattatttattgggctttggatgatattattttgtagcaggtactttttgttctttatatgcctgtattctaccacttctaaacacatccgtattgtggttggaagccgttctggtgtttttcttttttgagacaggatcttgtcactgaggctggagtggaggggtgtgatcacggctcactgcagctttgatctcctgggctcaagtgattctcccgcctcagcctcccaagtagctgggattacaggcgtgtgccaccaagcccagctaatttttggatttttagtagagatggggtttataatgttggccaggctggtctcgaactcctggcctcaagtgatcctccggccttgacctcccaaagtgctgggatgagccacggtgcccggccataatcccaactctgaaatcttacctgcccttaacattctgtaaaatatttattagagaacaacagtttcttcattctacaaatattgagcctctgtggtgtcccagacactattctgaacagcacaggcaaaaagccttcatggagctttatgttgtagaagagacagacagcaaacatgttaaataggcaaactttttttttttcttttgagatagagtctcactctgtcacccaggctagagtgcagtggcgcgatctcagctcacagcaacctttacctcctgggttcaagcgattctcctgcctcagcctcctgagtagatggaattacaggcgcctgccaccatgcctggctaatttttgtatttttgtagagacagggtttcactatgttggccaggctggtcttgaactcctgacttcaggggatctgcctgccttggcctcccaaagtgctgggattacatgcgtgagccactgcacccggccaaataggcaaattttttttttcttttttgagacgaagtctcgctcttgtcccccacgctggagtgtgatggcgcaatctcggctcactgcaacctctgcctcctgggttcaagcgattctcctgccttggccccctgagtacctgggattacaggtgcctgccatcatgcctggctaatctttatatttttagtagagactgggtttcaccatattggccaggctggtctagaactcctgacgtcaggtgatccacctgcctcggcctcccaaagtgctgggattacaggtgtgagccactgtgcccagccaaatagacaaagttttgtagtatgttaggtggtgataagttctgagtggcaaatgaattgagcaaggggagtgggagaagtgtgttaacaagtttagagaaggtggcccaggaaaggcctcagtgaaagggtcacatctgagtacagacctgaaagttaatttagtggcagttgtgaaaatggagacagaggaaacaatccccaggctgagttggccttgttgggagcatgctgagactcactgcaggtccagggctgttgtattcatttgactcccttaaggcgataagaagagcagggcagggccttcaggggccttaccagggaccttgccctgtgcacttcagctgccttctttctcatccttgactcctggccttgccctcacttttgccactcacttctggtctttcttccctgtagtcctaagattttccaaaagaccaagtgcagcatctgtaacagtgccttggagttgccctcagtccacttcctgtgtggccactccttccaccaacactgctttgagagttactcggaaagtgatgctgactgccccacctgcctccctgaaaaccggaaggtcatggatatgatccgggcccaggaacagaaacgagatctccatgatcaattccagcatcaggtggggatgagtgggctagatgggccaggggattcccactagtgtcacagagtcactggagggcttgtttccttatcacctcctcatttaagaaacaagcactttgattctgattcgtattccttccctcctcttctcctgcagctcaagtgctccaatgacagcttttctgtgattgctgactactttggcagaggtgttttcaacaaattgactctgctgaccgaccctcccacagccagactgacctccagcctggaggctgggctgcaacgcgacctactcatgcactccaggaggggcacttaagcagcctggaggaagatgtgggcaacagtggaggaccaagagaacagacacaatgggacctgggcgggcgttacacagaaggctggctgacatgcccagggctccactctcatctaatgtcacagccctcagaactaaagcggactttctttccctgccttcttatttagtcagcttgccatccctcctcttcactagcagtgtagatcattccagatcagtgggggagggcacctcagcaacctctgagtgtggacaatagctgctttcttctctatccaagagcaccaggctgtgcttgggtccttgctctcagagtctataaataaaagaatataatgatttgggagcttaa

SEQ ID NO: 171 - DNA, 85946 bp, Homo sapiens
ctgagtggctacaaagactttatcaaattattttaaatgttggcatttaagtattcatgtgtatacagttacatggaaccttcaggtcagtggggcacaaatgtggtatacacacgatgagcctggcagggaagcaaatgagaccaggcttggagctacagggatttaaaaaaattggatgtctttctgagggtctgagaagaatagggcagaagaggaaagggtcactttaggggtctggcttaacccactgcctagatctccaactgaagagctcctttcccatcctcaggggaagagtgcctgttttcaaacggcatccctactacacatataccccccttccctaaaatcttgatgtggcaaacacacccaagaacccacaggaatatgtccttataaatatgtttgtatcagagaaaacaaggcactttgggagcattatggcttactctactacatgtacatcattctagacagaaagtaaaaactggttagttcctcaagtgaattaactgaataaacttaatacaataacaaaattgttccctaacccacactgaggcacagttaaagggaacatggtaggaggcacagaaggaggcacagaatgaggcacatctctgcgcgacacctggtcccaggtcagttggaccccagcagggctcaaagcctgatgcctccaggaagcctgacatctctcatgagcaaagccccctggccttggagcactggctccctccctccccataccctgaagtcaggtgaggggccgcagtgggaggcagtcctagagcagagctgggacacggtgggaatgcttaagcagggtcaccaaagccacagagacctcaatctgtccaagctggcactgcagagtcagaggatgggcgccacgggaagagatttcacattagccgtgacaacaccgcctcggctctgcgttgacattggccagggtcgtttctgagggcgctcgggcttccactggaggcgagctggagcctgggccagctgctctgagcctccaagggctggctgagcctgccccctcccccaggctgctcctttggaatgtacccatctcacaaccaaggcaaagccacaagttgcttctgacactattggaagctgggccccagggccacaggaatgggggcaggtcccttgggcggggtgaaccaggaagggaggaggctccttggcttcggcgcttaggagtccttatgggccattgttccatactctcactagcttaggcccagattaaataatcactaaactttgcattctacattacgtgagtccaaaaacaggattacctgcattgggtcctttatcatcttaaagggctctgggtctaaagaagccttttttttttttttttttttttggtgcatatgcataagtggagcccagagggcctctcggctcactgggtccccggccccccgagctgaggaggcttcgcaaggccggctgctacaaagtgccgagcttggctgcatagattttaatgagagcgtcaggcagagctgtgctgttgctctccgggacttgcagatcattaccaaaccaactgtaggatgagaacatagcacatcgaaaccctaggaggtcactgagctaatgatctaatcctaccttccgcaggcagtgcccctccccacctcctcctgcccccagccctttccacgatggactcagtccattccagaagccaggccaacaccgcccccttcaaggtcagagcagaatgacagtgagtggctctagctctcccttttccgggcaaggaggatgggggtaatttagtcaaagccattaggcccaaaccctggcctggccaggccccaggtctcctatttgggagaaccactgccctctgcctgcctctccaactactgctgggctgcggcccaggcgccttcaacgaccattttagggttctgatgaaagcaccttcggcttctaaggtgcaggctgggaaacaaggtgggggcccacatagcctggtgtctcagcatggagcttagtgccaagtcctgtgccagagacacctgatgtgtaaagagggaagagggcacacttgggagtggccacagcaagacggcatgctgtcccctacaggctcagtccccacaccctgagttccaggaaagaaggcagaggagaagcggccagcaagggcacagaggcagaacccatgactatacactctctcctcaagccggagggctttatgagggctttggcaattactacaaccatttgctgtgctgggtagggacagatcctgtttctctttgtttcagggctctgaaagccggagaagccagcagaagccgatttcagcataagaggctacacaatagttagggcagaagaaaagaaacctcactgttggctagagctgaccagtttttttctgaataatagcacctgtgtattagctctgggaaaagcgggaagggagggagggagggagcgagcttcaccatgtgcagtgaggggagctggaaacaggacctggagcccctctgcctttcagcctgcttcatggctgccaggcaccccccacccccaggcaggtactggcatggctgccagcctgagggactgaagtttccacagttggcagaatctttgtttaaattggggaaataaaagggggaggagttgcagaggaattgaaagcagcacctgtcaaagctgcctatccccttccttctctcactacttctggtcccccagagaggctggtcccaaggctatgtggttggctggtgacagaaaaggggcaacaaagaatgacaagagaggctatgaaggtctgagcagcaccgacagggctggcacagaccctgagccttcctactgggaccccaacctatggtgaggtctggagtagcaatacaactgagaaagctctgcccggactccagcaggtgcccattctttggtcccagaaagcacaggtgacttggaatcaggaactctgcgctctagctatgtcactatccaattgtgtgaccttgagcaagtcacttcccatctctaggcctcagcatccttaaagggtgagacccacggggctccactgttcttccagtcctgcagctccaagtcttcaggctttgctcctgacagccagaagaggcccctgtcctcatgtgtcagggatagtttggtcatggatactagaggttaaaactgggctgtgttgcctgaaggtatctagaggtggtggtggtgcatcctgaacaccatactcaccaaagggatcctgggagggaggcaacaacaccagcctacagaaaggcatcatttttgggcagaggaggtgagacattctttagaggcttgatgcctcctggaataaagggcatcccaggcatagagatcgcttagcaaaaggcaggcccaccctgctgattagggcagagggtgaggcagtctggcccttggacccttcggcctactctgccctttcagtgcgcgggaaaggggtcagctgtgttcattcagaccactccccgttttagaaccagaaggtggctggcattcgaagtggctgagggcacaggttttagaaggctgtagttgaatatggctcctaagggaagccccatctccaacagaaacccgatcaaaggaatctgctttgggatttctccttcctttcaatatgcaacaggcacttgaaggaaagagggaacatcccagctactgaacctcaggagccccacagggcctgaaaatggggagaggaaatacatgttgacttggaggaagcacttggatatatctttggttgcttcagggaaagctttggccccttaaaattacttttttcctcccttttctccccctacgggtctgttggggttggcatcaaagaaggcaggtaggaaggaaagaaaaagaaggtgggcagcaggcagaaagagttaatcggaccagtcgtcctcatcaaattcagaggagtcatcttctgagtcactgtactcaacagcaatgcgacgagacaagatggtggccacgtcattgcccacaacatcccgcttctcttgttcccgctgctcctcaaccctgcgcagctgaaaacctagtggcaaagagacagaagggtgaggaaggcgtgtcctcagccttggaatccatctggaactgggtaagagggagtggccaccaatgggtaagtggtattggaaaggatagagaaaaagaaggttgttatggaaaagcagaagaagatgagtttatgaaattgatggccctgatgtcacaggtgtgtctgaaaggcagcctgctgtcctttctggtttacacactttcaggctggtgaggacttctcataaggctttgaagtggggagcagccaccacattccatctagcagaccctcagcctgcccaattccatcaattataatggggctcagctgccatagactgtcctctctagattagaagttttttgaggatcacaaacagaacaaaccacgataacaccttgggaccagacctggcccctgatagaataaatgctccaatgttccaggagggtgagatgatgaagggggagggaaggggaggggagggaagaggagaaaagaggagataaaagaaaatgggagaaaaaaggagttagaaagagggcagggggcaaggaaggaagacacgaagggcagagcagtggagaaggctggggagttgctgagtccagttgaacaaggacccactaggacagtgattcttgttttttttcgaaggcacaaaacccttcggagaaactgatgaaaaatggggatccttccccaaggaaaaaaaaatgcatgcaaacacacataagcatatatttccaaggacttcaaagatcccagcttaagaatcctttactttggccgggcgcggtggctcacgcctgtaatcccagcactttgggaggccgaggcgggcggatcacaaggtcaggagatcaagaccatcctggctaacaaagtaaaactccatctctactaaaaatacaaaaaaattagccgggcgtggtggcaggcgcctgtagtaccagctactccggaggctgaggcaggagaatggcgtgaacccgggaggcagagcttgcagtgagccgagatcgagccactgcactccagcctgggcaaaagagccagactctgtcccccacaaaaaaaaaaaaaaaaaaaaaaaaaaaagaaaagaaaagaatcctttactttaaaccaaggtggaaagaaatctaaatctccatatttttagggtgaagccttttctcaggctgctcccaggcctaatgtcccaatctctccccacccaatgaaagccgtttcctgggaagggcacagggaccccctcacccatcccccaatcagtcatcccagcttcagaaagacaaggctccacagtcccaaacccaccattgaaatttaccttgacggatggctgaaagcaggtcgctacgggcatcgctcacggcaggcaaggaggacttgggcttggtggtatcagaaagcggtggtggtatagcaggctggccatctgcaccagtgaaagggggaggagggggccccggaggaggaggaggagggggaggaggaggtgctcctcctgttggctgggacaagggaggtggtggcagagttgggtagtcagctgctggtggtggaggaggaggtggaggggcagcaaaatcagggtgaggtgggaaagatgggggtgagggtggtggaggcgtccctggagacccaaatcctacaggcggtggtggaggtgggatgcctatcattggaggcggaggtggcggaggggcaggtggtggagcaaacccgggtttagggcctggtggagagcctagaggaggagctggtggtggatggcttgggctgaccacactggatcttttgggtccagccaaaccagatcctctttggttgtccactgggtaactaaaaggccaaagaaaaaaagactcaccatcacccttagaatgcagacacctatctacagttagccttgtctacagaccgaggtttatcttggttgactataccatttcactttcacttaaacagaaagaaaagcctacagatggtcataacagaccaataatgaaataagcagccttttaaggtaatgagcttcccaccagtagaggaggatagacagattgagtaaaactacctgcaagaagtggacttgagattcctctatcaggtacaggctagctgagacatctcttcggccccctctgcctttccagctctaaggggaaggcaccctccctccccttccctaagaaggatggtccatggcagttgctagtttaatcctggagccagtttaagggtgcatgcaagaaagaactggaataaaaattcaaacaccacccacacactaggctctgtttctcaggctattaacattcaccagcattggagagggcaggaaacccaagccaggctgaccacacctgagtgggatatagatttaggtgaatgcatcttcagtgctcatgtggggaaatcttgagagagaatgaatctcaatccgagaatctgcagagatgggaaatgaatgtgccaccagactcctgacccaggcctgaaagaggattaaagctacacctctcctgggatcagatttgctcggctgcagctgcaaggtctcaggccatgtgtgaagctgaaggttttctttttccacctttgtatctaccctgcactaacagctactccttagaaaagcagccattttggaattttccacagaccttccagccttagctgcatctgacagggccaccagcaggaagtgatttgggaagcagaaggagatttgggattaatggtttctagggccaagaagaatgaggggagagaaggaggacagcacagctttaggtctccatccgaggggtcctcaacatactcaatttctaattaagaagtacccaaggagaaaagtgcacctttcaaagctctcatttatcaggcatcagaaaggacaaaagtaacggagaaaacagtgcaatctgaacaattctcagatctcttttcagtcattactgcctaacacttccactgtacacctctgccagggacatgcacaaatatcaaaatggacgaatttggagtttcatcccccttttccctttgtttcattgtttctggagatttgacacagcagtgaaactaaccagaagcactaagaggaagtgactctatgctaggttcctagacaactgggcaaggtaactgctaactatatcatggacagcagattgtaccacttcatttcatgatgagttaaagctaaggaaaaggctgggcatggtggctcatgcctgtaatcccagcactttgggaggccgaggtgggcggatcacgaggtcaggagatcgagaccatcctggctaacatggtgaaaccctgtctctactaaaaatacaaaaaattagctgggcgtggtggtgggtgcctgtagtcccagctactcgagaagctaaggcaagagaatggcatgaacccgggaggcggagcttgcagttagccaagatcgcgccattgcactccagcctgggtgacagagtgagactccgtctcaaaaataaataaataagtaaataaaataaagttaaggaaaaaacaagaaagaagctggtgatttccatttgtttcggtataggcaaaacaggagtagttaagaatataggttctggagttcaactgaccaatcagggctctgcccttactggctgtgacctttgggtcatttcattgacccctctgtgcctcagtttactcattgtaacatggggatagtaacagtgcctacctcaaaagaggactcctatgagaattaagcaacatatacatacagtgttaattatttctattatctagacagtcttgtttgaagttattttagtggtcttgacctagggttttaactttttgtttgtttttgtttttggtctcgctctgtcactcaggctagagtgcagtggcatgatcatggctcactgcagccttaacctcccaggctcaagcgatcctcccacctcagtctcctgagtagatgggaccacaggcgtttgccaccatgcttggctaatttttttgatttttagtagggatgaagtcttgctatgttacccagactggtcttgaacttttggcctcacgagatcctcccaccaccttggcctcccaaagagctgggattacaggcgtgagccactgctcctggtccattcttttgttctcaagtgtataactaccaatagtggatggagtaggtaccaccatttacctgaattctgctggtggaggaggcaagttgtcctcggagaaggaaggagaaggtgaagaagcagagtctgactgtggtggtggcggatagctacttgcatccacgttttcaacacagccaatgctgccattctggtacaccaaagtgggtggatacctgacaatgaaccgaatgccaaaaactgtcatttaaagagcctgagtgggttttttcttcttaaaaggtactacaaaaatgcatttgatacaaaagctattagggagaagtaaaataggtatatttcccacatattttctgttacactgaaattttattttaagactaaatattctattgtcaaatatatcccagatatttatgctgaattgtttgtagtaacaggattcaacccagattatcaaaaccatgctgttccttgcccagtgttggccttgtcaaacccagcagttcttttaaattctctccccagtgtcaggtgcagatatacctgaatcccaaagtctgtcctgtgacaaatgtgaagccaagtctcagaggctagtgagctgcaaacacgtgactggcacacagactgattttgaggtcagcaagcctctggagagctcgaaggccaaggaggcactggattgcaaaatcaagctgaggatgaatgcagggtgctatgtggtagtaaatgtggtctttctgccaggtctcttatcaaaccaaatgagctgacgattaaagtagcgtgctagggcttgtctcatgaaaacctgtccctcagtgcactgggccttgggtgaatttgttctgggtgaacaacaacaaaacttcaaacaagcacaaatacaccaagcatcagctagcaaaatctggcctgctctgctccacctccccctctttccaccattgttggggtctaaagaactcatctaaaacagacctcagggagaacagagttggagaaaactaactgaatcaaaagatgctctgatgtggaaaatccccaaggcctggagccctggagccttggcacgtctctttataggttcaccaacaggcatgtccagatagactaaccatgaagccccaactccaaaccgcctggacaacaggaaaatggaaggcaaatcctcatcttcctactccacaaaaagaagacacacatgggtagctggcattctgaacacataagcttctggccttagagtcattgaacctatgacaagtgcctgtctgaacaggattggtccgtggaacaaaatgtccccctttactgggaggtgaaggtaatgaaggtaccctcagggctgatttcccagtagagaaaaaggttcattttttcctttcaccatcttcatcactctttaaagcagagctcttaatccacgaagaacaagtgtcagaagtgtcaagatttttaaaagtcaagattttcatggtagagttatttctaaaagcaagaacaactcaactctttccttttatcattcctagacacccagcatgggctggcatggttctctgacagccatgatgcagtgtatttagagaaaaaaccagggcgacattcatgccaagcagtcatggtgacttggctttgaatgtcaaccaggtcagacaccaggataagcatcaaaccaagctttaaaaccatctttttccccctttaaacctccagtgtgatttggtattgggaaatggggtcagactgacacctcttatttctccacagagatatatagcctcaatactggccaagcaacctttcccacactgtctatgaggtctgcattcagtcccttggctagcttctctcccatgactgacaaaggctgactgaaaagttgctttggtgatgtgaacagctttcttgcctagccctccccagccctgagagtgaaatgcccagttcttaggcatgaccttcaaatcaatgctctggaggcaaaggattcccaagaccacttttcttccctttccaatctttcctctggggcccttagatgtgtatctcgcagagtaagggcactaggagccatgggctttcttttccagaccactccaatcacctcatttaaatcgctgaatctcttgatttatttagcaaattttcatcaccagatggatgcactttaaagtagctgattaacagtggtattgatctaagccacagagacagacttcagggggtgtgaaaggtgtcacaccagagctgtcagactgttgtccccagccccttcaaagaatgctaccaacagtacaaaggcattacctacccagaagtccccagcttttctttggactccacaaattcttgccccatcttcattttctcccactcttccttacgtgtcttgattttacgtgggtttacattccctcgatttggattatctttcttttctttctataatgaaaaggaacaggaaggtctttgtagaacattttccaagttcttcattaaaattctacccatcttcatggatgcgtatctaagagataatctgcctagacaacatacaataactacagaacttacagaattactgggtttgaagtgacccagaggccatctaatccaaaccatccccgggtgaaacatttgctcaatcccacactcaaatgcctccagcaacgggaaccccacttcctctttggataactcattcacatttttgaaaagctctaattgctagatgttagtaaacagctatttattatttgctcagccccaaaggtcagtcaagagagatgagatgtaatgagacctgcagttatctggggcacatataaggaaatagtttaaacaaaacaaaacaaaacaaaaatcaatgaagaatttttccgcctgtgcagctgctcttgcccctggcactctcttgggcctcctggcagccatgctaatgggactgaggttgcaactggtaggtcacatacataccaggaagagtctatggggagggagaatcttcaaaacctacatatatccccccaccctagccccgcccagcccgtagcgaaggcattaaactgctcctgttgcaaatcaaacactgcagaaccttgtgctgatctctgagaaatgagctgcaaaactagtggagaagggactagcctagcttgagtgtccagcagagtcaggtgcaaattgcaagagaaataaatggtgaatagaaaagtcaatttctaaaactcagcctgaatatactcaattgttaatagcactggggggaacaaacacatttttggtatgatttgtactttcatcttggttgtgcttggtgtggacacatttttttaagagtttcacctggcatccaagcaagcagccacttgaaatgattacttcacataacactggcttcctttttatccccctccacaatcgtgcctactgatgtggagaacagaggcccctttcccctcaccctatgctttctcttctctttcatgatatccttggtgtcctgcagcatcttctccttccaaagatcaaagaagtatgaagggtctgtgtagaatttgagtgcctcttttccatcgtccctgggatagaaatgaagacaagtagctgtcagtagacagatgagctcccaaccaaatccaatattccaaacacctaccagttagcagtttttacaccaaggaatcaagaagtcatttgaatcgattgcatacctcctctcccataccagcatttcaatgcccccgaatggcacctctctacttatcagactttttaagaaccttagccttactttcaattcctggtagatgaatgtgcattgtcagggcaagtacaggtgatagcagcagggatcctgattacttctgatgatctgcatggccacagagatctccctgaggatattcggatttcctggtacatcagaggggatttctaccactggttcctcttttcccaccagttccccaaggactctctagaaagcatcagtagcttcccacccaccggaaacctgtgtgcacatgtgggagttcatgtgtatgcatatgtacacatatatacgtgaaaagtgtgtggtttacagctgttatttctctgcacacacagaaaaccaaccacagcactccaccttcttgctcccttctagaacagctcagcatccacatacaccccaaccacaagagggctccagtgagaaaagatggccagctgttgtaagaccacaaggtttaatcaccagcttctaattaatggctgtgccagtgggacagagtaaactacttagtgtccatataagggctatctgccagattcaatggtcctagttggaatcttgcattttggcatggataaggtcctctcactatccagaaaggatgtgcttaggagtgaacatttatcttaacattattctgaactaaaaagaactggaaaggcaattctattccctaccctccaatcctatcacaacacagaaagcacttccaaatcaaacattaataatttctatattaaatcttctcctgagttagatacaccaccactcatttctgttaggccaagttcagataactgagaggccacgctaattctgacactgtatgctaaaaagaaaaataccattaactgaagaataaaattctcctaatatcatttgtttatgcaatcccaccacacaaaccctatgttatactcgctacaatattatcagttgtatgacccctttctgccccacaacccctctgcccaaacccaactagactcaataacggaggctgcagagtcaaacctctgtcctgctatgctggtccctttgaaagccaaggggcaaacataattttacaagtaaaatgaaggacagatgccatgtactttatatctgtgtgagaaggctccctgaatctgactggtgtccttgaatttcacgtgggtacacacacacacacactctaccttgcagtgtacacatgtctgatagaagacatctgcctccagctatctgtaattactttttacctgctccaaagatatatatgggtgtaagcaagataaatattcaccttctgcccctcttcagtggttttttgcaggatgacaaaactaccaaaccactagaggagaggggctttgtctataaggctaccttctttttcaagtccaggcacagcagagtaggtccttacagaaggaaatgtccaaaggatgttcaaaacaaagtgaacgatgctcatttggaagaatgcgaattactccttaagctttggaaagacccctttgggcccagagcagccaggccaagaggctggccccactaacacacccaaacatctggtaatctagtggtttccaagtaagtgggagccttgctagaatgttgcccctgggatccatgatccatgctgtaggaccgccttgtaacaaagtccttttggttctataataactaaattccttggatggaatccaagatggacctggcttatatgaaattaaattctgtagcatgcaatggttacagtaaactttcaatatgtattatattcactatgaatttcagaaaccaaacaataataagtgacaatttttatggtgtaaattttagtttctgctgccacagaaactaccacaactttggggtaggcagtaagcttttagatacaatcctctgatggaaacaaccgcttcagacaaaaaaaaatctagcgttattaaaccataggttgaaaaagggaggaactagccagccattacctgtaaggggtaagattgttgagagggggaggagtatcacaggtattgtatgtttctaagacaggcactgggagagagtttctgtcaaaaagcttctggtcttgaatggtggaacttctgaaggcttttcgggtgttgattccttgcagtgacactgagagaagatggaaggcgttagaaaatggacgacaggctatttgagcaaacactgagtcacaccagtcggagaggcctcagctgctgcacttcttggctgtggctgtccgcagccaggctttttttttccctccccctctggggaagccccacaaggctgtcagcagcccagtcgtttcacgactgaacaaaatgaggcaacacaaaggtttactatgtggccagatctagcaggcctctccttaggaggaatgaatcttccaagtacttttatggtagcaaaatacgattgagggaggggaaatttgagaaagaaggaattgggggaatgggagaaaggagtgcatgggggtgtggtggagctaaaaaggttctttccagcactcaggcttgtgtgatttcaaagcagaactctataggtctctgtgatttctctcctcacgtttttttttttttaaataaatcagggaaaaaaaattctacaaaactgctcagcagagcctgcaaatgctgagctcagctttcttaccttcttcttccttgggatccagctgagtgactttaacctgtagtcggtcgaccctctcagcaagggagcttacccgagaggcaaaggtatttgcctgagtaaagagctctccaaaaatgtcctctgcatatttacctggaaagagcaaagaaaccaagtcactagtgcatagaagtaacgtaaatggtcacaaaaactggctactaaagatcgtgttccctaacccccaaacacatacatatacacacacataccctaagacggtttgggctatatgcagatgactgctcttagagacagagaaatactcttcatagtttaggaagcctgcatatgttctataactaatagagtcttcttgacagacgtgaacagtcatgagactcaaaacaggctgaataaaactgaaaggtgtaatgcaaaaaattaagcctggaagaaaagataatatttctacacatttccagcctgggcaacatggggaaaccccgtctctactaaaaatacaaaaattagacaggcgtgctggcaggcacctataatcccagctactggggaggttgaggcaggagaattgcttgacctcgggaggcggaggttgcagtgagccaagaccgagccactgcaccccatcctgggtgacggagcgagactccaaataaaataaacactacacatttgcctatagcccttagcctcttgctgttctgtaaaagtaccttataaaacggttctgaaaaacagattgggagttcagaggacgttctacgtatctaaaattaacatgaaaaataggaaattagttcctcaatggagccttgaaaatacagtgaacaactatgatcagttgtgttatctttgaggggccctgagcttatcaacaagccatagcagagatatacaacttcttttaagaggtgggaaggttcctttatgttttataacttataatttttttttctttttttggagacagagtttccctctgtcacccaggctgcagtacagtggcgtgatctcggctcactgcaacctccatctcctgggctcaagcgattctcatgtattagcctcccgagtaactgggattacagatgcgcaccaccatgccaaactaatttttgtatttttggtagagatggggatttgccaggttgcccaggctggtctcaaactcctggcctcaagtgatccgcccaccttggcctcccgaagtgctgggattacaggtgttctagccaccatgcccggcttgtaacctataactttcaaagtctgctctaggttacaatccttcaaatctacatctcaggaaccaagtgaaaagctgaaactttcaagccctctctgaaaaacaacatagcagtggtctctttccacaatgtcttgttttttagaaaaagaaaagttccgtactttcaaccctggaatgcaaggagaatttgcagccaaagaaacataacagcaatttgacactacctctatattgtcattccaagccacaggcacattcttactaggaatgaaaagtggtgcatacaaataaatataccatctgagctttttttttttttttttttttttttgagacagagtcttgctctatcccccaggtggagtgcagtggcacgcaatctcagctcactgcagcctctgcctcccgcgttcaagtgattctcctgcctcagcctcctgagtagctgggattacaggtgcctgccacaacgcccggctcattttttgtatttttagtagagacggggtttcatcatgttggccaggctggtcttgaactcctgacctcaggtgatctgcccacctcagcctcccaaagtactgggattacatgcatgagccaccacgcccgggcctaccatctgagcttcttgcaaggtgaaggcacgcataagagactgtgcccaatcaaatgataatctttttttgagaactatttaaagtaggctctaatttttagcttcaaaactacatttatgcttagtccatatttgagggagaaaaaatagcctgaaaggccaaaaccacaccttcagggtgaactgcagctcaccttcccagtacaacctgaagagtggggataagaccaatcaactgcatattttgaattgctggtaaatttaagtcaataaggacttctaatcaaggaagaagcaagtccttgcatagtgatcgtttgtgacctaaacaactatgggacgctcctgagctcaaagaactcaaattggctgacaagcatttctactctgcaggttgaggattttatttgatccctgttctaatatggctaagttcctatgaaaaccatactgtatcatgcttgtctaggtaatggaaaattgtgtttggaaggttgaaacagagaaatatgcaacattatgtgtggaaaacaaaccaagctcaaaaatatctgttaaaaataaaagaaggctaggcatggtggctcatgcctgtaatcccatcactttgggaggccaaggtgggcagatcacttgaggccagaagtttgagaccagcatgggcaatatggcaaaaccctgcctctattaaaattacaaaaaaattaggccaggcgtggtggctcatgactataatcccagcactttgggaggccaagggaggcagatcacctaaggtcaggagtttgagaccagcctggccaacatggtgaaaccccatctctactaataatacaaaaatgagatgggcatggtggcaggcgcctgtaatcccagctactcaggaggctgaggcagaagaattgcgtgaacctgggagacagaggttgcagtgagccaagatcgcgccattgcactctagcctaggtgagacagcgagactccatctcaaaaaaaaaaattagctgggcgtggtggcggacacctgtaatcccagctactcaggaggttgaggcatgagaatcacttgaacttgggaggcagaggttgcagtgagcccagatcatgccactgtactccagcctatctcaaaaataataataataaataaaatgaaataaaagaaaagaaaaaagaaaaatatctattaaccatccagctattctggagggggaaaaaaaaaaaacaatcaacttacaccaagagtcaccaagagtacctaggatttcctgctccttaagtgaaggggatagtgatagtagaagtagaggctcagtgtggcacagtggttttcaagaaaaaatcttacacagaacctcaacatataaaactggtaacaataagatctctgttttaagaggaagtgaggtggtgtgaaggcttccccactatctcatcacctcaggcccgaggcagacttagaactatactgagacatggaaggagcagttgacttcaaaccagaaaatctgggctgggcgcagtggctcatgcctgtaatcccagcactttgggaggctgaggtgggcggatcacgaggtcaggagatcacaaccatcctggctaacacggtgaaactccatctctactaaaaatacaaaaaattagccgggcgtgttggtgggcgcctgtagtcccagctactcaggaggctgaggcaggagaattgcatgaacccaggaggcggagcttgcagtgagccgagattgtgccactgcactccagcctgggtgacagagcaagactccatctcaaaaaaaaaaaaaaaaaaagaaaattggaatcagtctcagctctttctatttatactcgtgtactcatcagcaagtcacaatctcccagccttagtttcctcatctgtaaagtggggataatatctaccccatcaagttaccataaggattaagtgagctaaaaatgtgagttgttacaatgagattcttccttatactcctcaaccacattacatgacttaagagtgtaaatacctaaggccagacacggtggctcatgcctataatcccaatgctttgggaggccgaggcgggtggatcactgaagaccaggagtttgagatcagcctggccaacatggtgaaaccctgtctctactaaaaatataaaatttaaccaggcatggtggcacatcatcttgtaatcccagctactcaggaggctgatacatgagaatcgcttgagcccaagaggcaaaggttgcagtgagccaagatcataccacttcacttcagcctgggcaacggagtgagactccatctcaaaaaaaaaaaaaaaaaaagtgttaattctaaataccctaagtttttgattttcaaattttttttttttattttttagacagagacttgctctgttgcccaggctggaatgcaatggcacaatctcagctcactgcaacctctgcctcctggattcaagagattctcctgcctcagcctcccaagtagaaatacaggcgcaggcccagctaatttttgtatttttaacagagaaggggtttcaccatgttggccaggctggtctcgaactcccaacctcaagtgatccgccttggcctcctcaagtgctgggattacaggcgtgagccactgtgcccagcctaaataccctaagttttaagcttagaggaaaattttaaatataattccaatcagtaatttgatagtatctattcttcaagtgctaaaaattactccaacttctgaaaacagaagtgtgatactgaactaggaaaaaccaaagtgtcttgttcagagttaaatttcactcactcagattaccaagacagacccaatatccatcattatccaacattcatacagataccacattttgcaaaagattctaggaagcagtcttcaattttgttttttccttagcagaacacttcaaatgagaaatgttacgtggaagtagaacaggtaaaactgatgtttaaaaatgtgaagctgctcttattgaagtctgagtgggagtcttggagctccccaatggcatgccccaccccctcacccacaccgcagtcagttagaaacccaatatctagcttgattttttaatgacccaagtgggggttccattctcccgagtggccacaatactgatacaaagtgctggctggctgtgcctgtatttcctaagatacagcaaccgaatatgcgaaatgccaatctcactattctgagaaaaaataagaattctggatgtgctgtcacagagccatctatggctgtggaatttttagttttatgctttatccattccataatcagactttcactactaaattgagaagttccacccaggtacaatgcacatgaggccaaggtcatgagcctgaagcacatatgaacccttccctgcactcctctcagctagatgaaatcccagtcatctttcaaggtcccattcaaatgtaacctcttctgtgaagtcttccttgaccccgcctatccctacctgtgcccccactacccacagaaagtattctttccattcctacattctttgtgcatcaatagcacggaatagtgggaaatatataggcgtgaattattcgacatttactgagtttctactgggtgacaggtactatacaaggtagacactggggttcaagaacaaacaatacatgatttctaccttcaacaatttttttttttttggttgcccaggctggagtgcagcagtgctatctcagctcactgcagccttcaccttctgggctcaagtgatcctcctaccccagccttgcacctcagccttccaaatagctgcaagtacaggcacacgccaccacacccagctaatttcgtttatattttgtagagacagggtctcactatgttgcccaagctgtctcaaattccagggcccaagcaatcctcccgcctccacctcccagagtgctaggattacaattgtgcccagccaataatttttaattgagacataggtgatttgtgatacaatgtgataggataatataggcatgtaacgggagctcagaggaacactcttagcccaacctggaagagaagattcctgagctgggccttgaaggatcagctacaggcagccagacagacaaagatggcaagggctgttcagccagtggggatagcaagagcactgtatggacatatgagagagcatggtctgtctcaggagaattactagtagctgataattcattcttttttgctttcctttttcattttatttatttatttgagacaaggtctcgccctgttggccagtgctggagtggcatgatcatggctcactgcagccttgaactcccaggctcaagcgatcctccaaccttatcctcccaaccagctaggactacaggtgtacagcaccacacctggataattttttaatttttgtagcgacagggtctcagtatattgccaggactggtctcgaactcctgagcataagcaatacttgtgtctcagcctcctagagtactgggattacaggtgtgagccactatgccaagccccctttttccattttaaaagactgtaaaatgaaggctgggcgtggtggatcacgcctgtaatcccaacactttgggaggctgaggcggttggatcacctgaggtcaggagtttgagaccagcctggccaacaagatgaaaccccgtctctactaaaaatacaaaaaattggccaggcgcagtggctcacgcttgtaatcccggcactctgggaggcccaggtgggcggatcacgaggtcaggagattaagaccatcctggctaacacggtgaaatcctgtctcttctaaaaatacaaaaaaattagccaggcatggtggcgggcgcctgtagtcccagctacctgggaggctgaggcaggagaatggcgtgaacctgtgaggcagagcttgcagtgagccgaggtggcgccactgcactccagcctgggcaacagagtgagactccgtctcaaaaaaaaaaaaaaaaaaaaaaaaaaaattagctgggtgtggtggcacatgcctgtagtcccagctactcgggaggctcaggcaggagaatcacttgaacgcagaggcgaaggctgcagggagggacccgagatctcgccattgcactccagcctaggcaacaagagcaaaactctgtctcaaaaacacaaaaattaaaaaaaaaaattgtaaaatggaagacagactgtagaaaatgaggctagaaaggaaggcaggtcttgcagggtcctgaatgctaggccaaggaacttaaataattccacagtgaggaagaggggagagaaatagttgcgatgtgtactctgactataaaaacacttgttacattacaaaagttaacacagaactttcaaagcttcagaaattcagaatcataaaaagtaaaaagtgagatttgatttttaggcagatcactctggcagggatataggaacagatttaagggggttggatcagagaaagaaggtagagggaggcttgggtaatagtttaggtgaaagtcaatgaagtctaaaccagggcaatattggcagagacagcgagtaagggacagagctgagaaatctgtaggaagtctgagtttaaacagtgactttgcctcttactggctgtatctctttaggcaagttaacttaattttttttttttttttgagatgaagtctcgctctgtcgcccatgctggagtgcagtggcacaatctcagcttactacaacctccgcctcccggattcaagcgattctcgtgccttagcctcccgagtagctgggattacaggtgtgtgacaacatacctggctaatttttgtattttttgtagagacgggtttcaccatgttggccaggctggtctagaactcctgacctcaagtgatccacacccttcagcctcccaaagtgctgggattacaggcatgagccactgtgcctggccaagttaccttatttttctgagccttattttctttatctgaaaaatgggaataccaccacctaatctcataggattactgagaagattaaatgagataatctatgtcaagatcttatccaaacctggcataaagtaggcaatcaacaaatgtgggttcccttctcactctcttcccattctctcctcttaggaattatttatttctgcctccccttgtagattatgagtcctggagggcagagacaatttcttattattgcctcttattcttattcttgttgagtatcccctcagcagctggtacataaaatatgttcaacacaagtttattggatgaataaaggatcagttagcccccacaatgtaagaaaatcttgtttccttgggcataaggtgactttggccctcagatcagcttccccaagataggagtggtctgatcacaagtgggagtgtgagcaatggcatccatcaacaccaccctggaaaaatagctgagagagagcgtaacttcagtaagtggaaataagaagcatcattagctagatgttctttgtcctatgaagaaggaaccagtgtgtgattgattgacttccacccatttggccttctcagagagagacagagagaggcagaaattatgcctttaaaaagcagtgaggtctctgcagccttgatgtgcttcctcgtcagctgcactgctgttgtgctactgtcagtgttcctttgtgtaagacaggcactggcagggtttcacttcttcatgatgccccatctaggtttctctaagccctggatcaactgagatgatccctgaggtaggtgaaggcttaggaatctcagactccatacatcatctggtcatagagttctgtctcctcagcctcctattttaaaggctgggcctattgctatacgggagaatgcaggctttcttgatattccactgccttcactaagggcagtgatgcgataggaggggtgactatctgaaataattcacaccaagatgcctttgctaaggaagatcactaaaatggcattttgacggaggttcttatgggagctggagtggcactagataaatgcagagccaatccaagcatctgcccttcccatatctcagcttcaagcaaacaaagtcaacttgattcagaatgaaatccaaaccacatgcatgtaccccacccaaggcagtctcattcattcttgccaattaaaaaaatatatatagttgagctggctttccttcagctccaaaacagtctgggctaacccccatcttcctcctaaggaagaatggctccagctactatttgtgtcactgtatgttcacacagcttgcaaaactcccaataccccagagactgcagaagtaatctgtaccctgaacttggacctgggggcttgcagcacaattaaatgtgtaccagggtggacaagtcagtcagaatctctccgaaggcatgtttgctttactcctctttgggaagaaaaggggtgggggtgttgggtagataaaaactattggcacatttgaggcttcaacaaagtcaggctacatcgaacagctcgtgtaattacaggcacattccccgacccaagatactgctctgtgaacctcccactttacacacacagaattctgctctgtcattccgtctgcagtttttgctgcagcccttcctgccacccttcccacagatttctgttgaagcaggtggagggggagggaggagggaacctagagggtggtggtagataaagaaggttgaagagaagaagctacaccaaaagggagcctctctttggggaggagagggaggatacattttcgcattacctagggaaggcagatgggggagaaataggaacgcgggaggagaaggaaactaaataaagagcaccaacgacccctgagggcaaagcacaggctctctgaggcactcactcaggctgcccagctgtcggatgacatttgccagggtgatgttggtcacgcattccagctcgcttctaacgctaggcaacgtctgacggcacaggtgccttggctcgatgttcctcgttactaacggcatggtggacctgcttcaggcaatgttctgaatggtgaaaaacaacctaaaaaagaaataacaggaaagtattactcaaccacaaattccaggcacactagggctgtgtgaatcttttttttttttttttttggtcttaccctgatctaaaacagctttaaaaaaaatcttcattctccctatctttttttttctttcatttttaagtcctctctcccttgccctttttaaggtttgctattagaagatctgctatgtaagtttagaaattatggactggtgactgctgcctgaggtacataggcagcatagaaacattaaagtgccaactactgctccaaccaacaagagtctccagaggcaaggaggcatggttagaaaacagcccattcagcagacactggacggtacagatcctatccctggggtgttcataaccaggacagatcagattctaggccaccaattataaagatcaaaaaagaacactgtcacctgataatctccacaatgaaatcaagctgccaatagtgattgatatacatcaggattaacttttccagtccttccttggtaaatggctgttaatgtatagctaaccactaggccgggcatggtggctcacgcctgtaatcccagcactttgggaggctgaggcaggtggatcacctaaggccaggagttcgagagcagcctggccaagatggtgaaaccctgtctttagtaaaaatacaaaaaattggccaggcgtgtcgcgggtgcctgtaatcccagttactgaggaggctgaggcaggaaaattgcttgaacccggaaagcagaggttgcagtgagctgagattgcgccattgcactccagcctgggtgacaagagcaagactccgtctcaaaaaaaaaaaaaaaagtatagctaactactaatgccagtatctcttaagtttagtttgtaaattgactgaacgagagaatataaagtaaaaattttacacattcaatatgtcaaacatgatgctgagtaaactgtgctgtaagattccctggtgctttctcttctacccaacagctccctttcttgctcccatccggttcaacacacctgggccaaaaggctctagagacagcaggaaatgtctggagcagatccggaaaccttccagttactgtttcttatccggtgggctgagcccctttccctaggaaatcccccagcacttcaggttcatgctgagctattgttttagatttagattaccgaattcctagttttacaaggataggagagggttttaatttccacaaaatggatatgactacagtcaaggcacaatgaactgatcctctttccacatcttataaaactaaagaaatctaaaacagcctaatggttttcatgctagggaaaatgacaaattcacttcacatgaaaaggtaaagcataaagttaacatacctaagtcctcaattttttttcttattttttattcttttttgagacagggtctcgctctgtcacccaggctagagtgcagtggcacgatctcagctcactgcaacctccacctactgggctcaagcgatcctcctgcctcagcctcccaagtagttaggattacaggcatgcaccaccacgcccagctaatttttgtatttttttgtagagatgaggttttgccatgtagcccagacttgtctcgaactcctgagctcagcctcccaaagtgctgggactataagcatgagccaccacgcccagcctttttgtttttttgagacggggtctcactctgtcatccagtatggagtgcaatggtgcgatcacagctcactacattcttgaccgccttgctcaaatgatcctcctaccttagctttccgaatagctgggccaagtccccaatattataaactcctctttatatatttaaaaaaaaaaaaaagcaaaacaagggtttatttacatcaaatcttaaaataccagctcatcaccaaaacgttgactgtgaatacaaaatgcttaaaccaaactaaatattacagacatattgtctgaccaaaagagaaaaaaaaatctttcaggctcaaagggggagtagaacccttcggaacagactgctccttgttatggacattctgatctgctacaagtaaaaataaaacaggaagccagcagcttggggaacaagatttcctgtcaccaacagcaacagcccaagaaccaagagaatcagctgtttgcttataactttgaacctccctttaatagtcactgtgtggcagctgtgcctatctttggggtgcagaggtgtttcctgaatacttgtctactgtctaaggaaatgatttccattccacttctctgctgaattccccctttgaccccatgggttttctagtccaaaccctggactttccaatttaactctttccctcttttatttaatgtaaagggtatcaggtactaagatgcaatcttcagtaacacatggtaaagagagtttagaacaggaaaggtgggaggaggttacatatgaaagaaccttgcagggctctgaacaccatcctctaggtgtccttagattcccaaatttcaaactttcaagatcaaccagaaatttggtgtacagccaggaatgactggaaacagccactgtggctcttccactggtaatcatttgagtactcattccagcttctcagaggagctaaaagaaccagaccaccttgaaatgctgtgctgaatgtgaccaatgacagggcattctggactttccctctggatacctaatggaaactagattccagatggctacataaatttcagattgagggtggggggcaaattctaacaccttggtactttagcacttatggttttctaagtgccttggataagcagaacaaacaactaactgtatgtcatctgtttggggtttacctggaaccaagttttctaaagcaaatggcttattgtcaaaaaggccacttaccacaaccagcgggagggtactcgagaaataacaatatgtcaatatctattaggacaaaacaattagaaaagtttatctgctatcgtttaaagtgatttgtttcaaagccaccaaagagagacaaaattccttgtatgtgaaatgacatgcaccattgctcatttttcttttggataatcaaggattggtttgtacaagaagcatggagttatgcatgatctgaaccacaacagtaacttgaccaagaagaaaaaaatcttacattcaggtgaaaataaacttagaattgggcaaaaagatttccaggctctctctctcacacttcaagttatagaaaatgtatcggctttatggagtcgacacattcttaggttagcaccctgactagtacaccttactgtgtgatcttgggggcaattttcctagagacattaaataatatatataaaataaaaaacccactacagggcttttaaaaaaaggcagttataggccgggcgcggtggctcacgcctgtaattccagcactttgggaggccgaggcgggcggatcacgaggtcaggagatcgagaccatcctggctaacatggtgaaacgccgtctctactaaaaatacaaaaaattagctgggcgcggtggcaggcgcctgtagtcccagctactcaggaggctgaggcaggagaatggtgtgaacctgggaggcggagcttgcagtgagccaagatcgcgccactgcactccagcctgggcgacagagcgaaactctgtctcaaaaaaaaaaaaaaaaaaaaaaaaaaagaggcagttatttgtggttccacagaccctaggcaaatcctcctgtagaataaatcctattcactgataaatattttatcttattatttaagagacaaggtctcactctgtcacccaggcctcactctgttgcccaggttggagtgcagtggcatgatcatagctcactgcaacctcaaacacctgagctcaagtgatgctcccacctcagcctcacaagtagccaggactacaggcacatgccaccatgcctggctaatttattatcttttatagagatggggccttgctatgctgtccaggctggtctctaacttttagcctcaagcaatcttcccaccttggcctcccaaagtgctgggattacaggtgtaagccaccatacccgggcccctcattgataaatatttaaaaatacttttaaccatagacatattatatggtggaatgcaatatttacactaaaaatttaaagacaaaactctagccttcaaaggaatttggcaggtttttcctggaggctgcttccagctgtgatcctggacctcctgaagaacatatactatctctttcttccagtctttcataactggattcctcatctgaaccacagaacaaaaaggatgattagagtgacagttttctcaattcccctcaagactgtacataactagcaccattctacgcgtactggagaaaagttaatatattacatataatgaatgcctaatgacattaagatttaattctttcatggaactccagttgagaaaggctcctctatcatcagtagcaccttactggtatagtgcactggatgttggggaaccactgaattatggaaggacaacagggtcacatttgcattttagacaaatcattctgcataagcacaggagttatatttgggcagaaggctggaagtaagaagaccaattgggaaattcttcacaggctgagaaggagaaagtagaaatgtaaaggcccaccctaccacagctagcaaatatgaactgagaaactagacaggtggcagttgcaggggtgagtccagcccctcagccccaccggctgctctctttagttttatacagttatactcactaagtgataaaatgtatgtttctttatcaaaagcgtcagaaaagagctgaatgctagcgccagtgaaggaaaacaaagagaaagtgaagaaaaccagtgaagtggtggttcttggtcaaaaaaggaaattctggatacatgaaagagtggaatgccctatctttatggaatctgtgaaggtctttttcagacatcttttactttgattagggaaattatatactatagtgatatctgctaatttggggatttgagaaggtcttaccttgggagatgtcaaataggagagcaattaaattagaactgctgagaatataaaagttacagggaagtagatttcaatttatctaggtcattttaattagaattgtccgatagtagaatggcttatctttagataaggttatgagttctccagccctgtgctctggatgaccagctatcaggcacgttgggggagaaatttctagcatttatgaaggtgttggaaagtcagactagatgacctctacaatgccttctaaatcaaagatgttataatttttattctgggctttgtgtcctcatctacaaaataaatggactaagctaaacatcttttagaagcttcccagctctaaaatttctagatgtgcttctacccaagctgccatgatctcctcactcagccaacatccacttgcattctgaacacacaatcagaggcacatttagggactgtagagaggggcagattatagccatgaatcatgccccttctccaggtctacatctgtctaattactaggacctgtgagatctagaatggcccaaaggaagttccagacagagccctgaggttatttatacccaaggggctcctggactgatcaaggagttagctacccaaaaaatttcaaagaaaaactgtattttggaccagctccagacatccaggccagattcagcagtaaccccatcttcatctgtagcaagtttcagcctaagggacttgagaatgagtctgaaaacaaataaaagactgccagaacttcctagccatggcctggcagtaccagtctggactgttagtgccatgatggcattcgtgctttgaaatggaaactggatgaggccctttaaggtcccctcaaacagtgagattcttcaagtctgtatatttgaagttatcatgcaattttttttttttagacggagttttgctcttgttgcccaggctggagtacaatggcacaatctcggctcaccacaacctccgcctcccaggttcaagcaattctcctgcctcagccttcccaagtagctgggattacaggcatacagcaccatgcccactaatttttgtatttttagtagagatggggtttctccatgttggtcaggctggtctcgaactcctgacctaagtgatccgcccaccttggcctcccaaagtgttgggattacgggcgtgagccaccatgcccagcctatcatggaatacttttatatatcacctttggtcagtataaagttaaaaagagactctggggccaggcacagtagctcgcacctgtaatcccaacactttgggagctgagaccggaagattgcttgagctcaggagttcaagaccagcttgggcaaaaaagccagaccctgtctctgcaaaaaattttaaaaattagctgggtgtgtggtgctacatgcctatagtctcagctacttgggaagctgaggtgggaggatcacttgaatccagaaggttgaggctgcagtgtgtatgattgtgccactgcactccagtctaggcaacggagactctgatatccaccctactttctgaactctcatgactgctcccaacagcctggggtggggtggggtggggtgggatggggtgagctgggggttggagggtagaagaaaacaaaaagggagggatatctgtgagagaagggaggatgcactcatctgtgccccacactctgaactcctgttattaccagaagacagatagatgactgctcattcttctggctatgtttattactagctgttcatgacaaataaacaatgctacattttgagccaaggtcactgataacacctgcagatttctatggtcacatccaaaaagcaaacatatttgagctatagcaataaccatcacaacagaaatgcttctcaaggcagttcctctttgaaacatacccccaaaatgctgatcagcagtagcaggggatggaacatgtggggatgttgcatgtgtggcaattaggacttctgctttcacttcagcgtttcccactgttctatagttaacagcactttggatggggacatatgagaagaggtttactcttgagtttcctctttcaagagatacatttctttatgttaaagaacatggctgggtgtagtgattcacacctgtaatcctaatactttgggaggcagcagcaggaggactgcttgagcccaggaattcgaaaccagcctgggcaatatagccagacctcatctctattaaaaacaaaaagattagctgggtgtagtggcatgcggctgtagtcccagctactcagggggctcaggcaggaggactgaggattgcttgagccttggaggttgcagagagctacgatcacaccagctggagtggttgcactccagcctgggtgacagagccagaccctgtctcaaaaagaaagaaacaaaaaagaaaaagaatatgcatttcactaggtttaagaatttcagttggaaagtcgaatagtcatttgacttcaaaatgacagacaatacatggtcttactgaaatttaagtctgtatattaaaatgtttaaagtatgaatttactgttgcatatagcagtcctcattaccatgcagcaactacaaggaagaacacttcattataagcttaggcacccacccacttcctgttgaaatacagggtggggctaaactaacaaatataaccacactctctctccaagcacaaggaatgacaaatctgtttaggtcactaaaacaatgtccaaaggagctagtaggacagaaatggaactcctgcggtagatacagaaagtatttgactgggaaaactgagaaaaagggcttacttgtgatctaaaagagatatttccaatttcataaaggaatgacacaccaattttgtgcctacatccaatcagtgtagggatacttcttgtcttgatatggctttaagacagtagctgaggaaacagaacttctaaactccagtatcttactccttgagcataaggtacatctatgaaggaccattcattcacacctggtaattccataactttttattatcttttgggggcaatagcaccttttgttcttacccttttacacttaagggtctaatcatagtttcgttcttaaaactaaaattgggggaatctctttaaccttcaaaattggtttcttctagtatcaactttttcatagaaaactgtcttttaaatggccaaaattagactctctttttagcaggatccatctggttgtccaaaagaaaatacatttaaactgtgagttggaaacctggattctagctttcaatctaatgatgacaggcaatcggggataaaatttcaattcatccctctagtccagctgtaaactacactaaaaaatgcttgaaagatgctatatgaaacagagattttgtatgcaaagtattctgagctctgaggaaaagatttacccgcataaagtatttcttgtatctccatcttggcccaattccttgttatggatccacttaaattacacaggatctacaatgtggtcactgatgactttcagttacagacaaagttcattttactttcccaatctaatgccaatttctagtaaaacccatatcaccaaaattgtatggtttgaaatacttcaaactacccatctaaatgggcttttactttgattggataaatatagattatgaataattgtacttataaatggagaaatcttaccctttactcctaataaggtatcagatttctttcagccattgtcatcaactgaacattaaatttacacaggagtttaacatgaaaaacaactaagctgttctgaaaaaacaacacccacacacaaaacaaaaaaagtatcaaacctcaacaaatcagttcaaatcattcactagattactagaaatatgtcaataactcacacaagccccaataaaatacccttcatatttaaacgattctttttaaatttatagccaatgacagaagagagtgctctccagttgatggtacccagaaatttgagataagaggacagatacaaaatgcattcctctccaagtacctgggaggaagccaaacctgggcatgtattctcccagacaaacagccaaaagtccaatacacagcttggttttatggaagggtctaaccccattttactatcatactatgcgatggagaagatggggctagactgcaacctttctttcttggctcttgcaagcagcactgagtactgtactaggttaaacttcctttggtcaaggtattagagtacccactggtggattagctacagtggcaggtttgaaaatagaagaggaaggagataataagagctgaactgcacatcaggcactaagtctcaattcatctggctagctgtgtaaccatttgttttaattgttatgatgccttacttcttatttcaagcttctctttgcagtaactgcaccctctctgggatggaaagaccaagaaagaaaccaactttacacaactgagaaaggccagggaaaagatggttgcagagcaacaacaaaaagaaaattcagcaaaatgttttgttgacacttcagggcaatacacaaacacactgtgtggtcatggagcaggtgggcggaagcagcagtcctgagatgtgactattaatacaccaacttaagtgaggagagagacctagcaatcacaactacatgtgagacaaggagtggaattatggagcaaattgccatgcaattccatatgaactactcaatagccagctgtaacaagaattcattcctgaaaaagtgtcacacacatatctgtcactaatggccaagccaccagcaactgactaagagtcagcagcaaagggcagctgtacatctacttcctctcacaacattcagtcagcactcaaagcatgagacttacaagctaaagtccttgagcagagggaaaaataagtatctgttctttcctttctaacctcagtttaccaggaagttgccaaagccctaaaaatctagtaagcagtggggcagagcaagagcatgaacattaagagacacaggtgtgggtttcactccaccactgccacattttatagctttggaaccttggcaagcagtctctcagtctatttcctagcctgttaaatcattatcatgaccccttgtctgtaaagttgttgtgaagaaaaatgaaataatgcatgtataaaacgtttagcacagtgcctagcacagaataattaaaacaacagtagtagtaatagtagtatcatggtagtagtggtggtggtagtagtagtagcagtagaatgattgacatctatctagcacatgccctgttctaaatgtttatatatggttctcttaagcattatacaatactgtcttaataagcttcaggtcgtattaatggttaactactaattatagtgctgttatcaatcactgaatatttatcaagaagacactaaaagacacaaagaagtataaaatctcttcccttgactccaggagcttataatttagttcagagagagagaaaaccacagttaagtaacaatatagcaaataaatagaagttcaattatgacaatagaaaggatgaaaagatcactgtgaactgaagggactgaacagactccttggaaccttaaagatctgaactggggctgggtgcagtggctcatgcctgtaatcccagcactttgggaggccgaggtggaggatcacttcagcctaggaggtcaagattagcctgggcaacatggtgagaccttgtctctacaaaaaaaattaaaagttagccaggtgtagtggtacacacctgtagtcccatctacttgagaagctgaggcaggagaatcactttaacgcgggacgttgaagctgcaatgagccaagatccatgccactgccctccagcctttgagacagaatgagactctgtctcaaaaaaacaaaagtaaacaaaacaaaacccaaaacctagtatctgaactggatagaatttggatgtaaaaaaacagacggaaaggtttttcaaggagagctaatatgataaacagaagtcttgaactttaccactagtatttatggaaaagtcacaattccaatgggtttctaccatatttcatcaaatttaggatgccactgattgaaagaggcattacgattcaagagatgttaaaatggggtgggtatggtggctcatgcctataatcccagcaccttgggaggccaaggagagtggatcgcttgagctcacgctttttagaccagtctaggcaatgtggagaaatcccgtctacaaaaaatacaaaaattagctgaatgcagtggcgcacagctgtagtctcagctactcaggaggctgatatgggaggatcactttagcccaggaggtcgaggctgcagtgagcagtgatcacaccactgcactccagcctggtgacagagtgagaccctgtcttaaaaaaaaaaaaaagcgatgttaaaatgtgaggaaaaaatgtatacctgagtcaatgaaatataaacatattattttagagacaaggtctcatcatgttacctaggctgaaatttagtggctattcacaggcacaatcatagtgcactaaagccatgaactcctgagctcaagcaatcctccagcctcagaaggtggacacggtggtctttaaaaaatctctctaacactaaaatgcattctataactcagacttacaagagaatagttatgtaccacataacaacatttcagtcaatgatggactatgatggaccacatatatgacagtggtcccataagatcataacacttttttttttttgagatgaggtttcactcttgtcacccaggctggagtgcagtagcacaatctcagctcactgcagcctccccttcctgggttccagctatcctcccgccttagcctcccaagtagctgggaccacaggcacatgccaccacgctcagctaattttttgtatttttggtagagatggggtttcaccatgttgcctagggtagtctcgaactcctgagctcaagcgatctgcccgcctcagcctcccaatgtgctgggattacaggagtgagccaacatgcccagccccttttctatgtttagttatgtttggatatacaaatacttactggctgggagtggtggctcatgactgtactcccagcactttgggaggccaaggtgggaggatcacttgagcccaggaagttgacaccagcctgggcaaaatgacaaggccctgtctctataaaaaatgaaaaacgtggctgggcgtggtggctcacacctgtaatcccagcactttgggaggccgaggtgggtggatcacttgaggtcaggaattcgagaccagcttggccaacagagtgaaaccctgtctctactaaaaatggccgggcgcggtggctcacgcctgtaatcccagcactttgggaggccgaggtgggcggatcacaaggtcaggagatcgagaccatcctggctaacatggtgaaacctcatctctactaaaaatacaaaaaaattagccgggcgtggtggcgggcgcctgtagtcccagctactccggaggctgaggcaggagaatggcgggaacctgggaggcggagcttgcagtgagccgagattgcgccactgcactccaggctgggtgacagagcgagactccgtctcaaaaaaaaaaaaaaaaaaaaaaaattagccgggcgtgatggcacatgcctgtagtcccagctactcgggaggctgaggcatgagaatcacttgaatctgggaggcggaggttgcagtgagccaagattgtgccactgcactccagcctggcgacacaacgagactccatctcaaaaaaaaaaaaaaaaagaaagaaagaaaaactcagctgagtgcagtggtgtgcacttgtagtcccagctactcaggaggctgaggcaagaggatcctttaagcctaggagtttgagtctgtggtgagccatgactgattgctccactgcactccagcctgggcaaaaaaatgagacttcatctctaaaaaaaaaatagtaaataaaataaataatcaatataaccagcctgggcaacatagaaagaccctatctttacaaaaaaattttaaaatatgctggatcccataaacatatacaactactatgtacctaccaaagttaaaaactaaaaataaaggctgggcgcagtggctcacacctgtaatctcaggactttgggaggccgaggccggcagatcacaaggtcaagagttcaagaccagcctggccaatatggtaaaaccccgtctctactaaaaatacaaaacttagccaggcgtggtggcacgtgcctgtagtcccagctactcaggaggctgaggcagaagaatcgcttgaacccagcaggtggaggttgcagtgaaccagactgtgccactgcactccagcctaggagacagagcgagactccatctcaaaaaaattaaagttaaaattaaaaataaaaataggccaggcgtggtgcctcatgcctataatcacagcactctgggaggctgagatgggcagactgcttgagcccaggagtttgagaccagcctgggtaacatggataaacctcatttctatgaaaaacacaaaaaactagccaaagggccgggcgtggtggctcatacccgtaatcccagcactttagggggccgaggtgggcggatcacgaggtcaggagtttgcgaccagcctgaccaacatggtgaaaccccgtctctactaaaaatacaaaaattagccaagtgtggtggcacatgcctgtaaaaccagctactcaggaggagaatcgcttgaacctgggaggcagaggttgcagtgagccaaaactgcgccactgccctccagcctaggaaacagagcgagactctgtctcaaaaaaaaaaaaaaaaaaaaaaattagccaggcacggtgccgaaaacctgtagtcccagctactctagaggccgagatggggggattgcctgagcccaggaagtcgagcctgcagtaggctgtgattgtgccactgcactccagcctgggcaacacagtgagaccctgtttctaaataaataaataaataaaaaattagccaagtgtggtagcatgtacctgtggtcccagctacctgggaggctgaggtgaaagcatcgcttgactccaggagtaagaggcccacccaggcaacaagagcaagacaccgtctcttaaaaaaaaaaaaaaaaaaaaaaaggccaggcacagtggctcatgcctgtagtcccagcacttcgggaggctgaggtgggtggatcacctgaggtcaggagttcaagaccagcctggccaacatggtgaaactccgtctctactaaaccacaaaaactagctgggcgtggtggcaggcacctgtaatcccagctacttgggaggccgaggcaggagaatcgcttgaacccaggaggcggaggttgcagtgagccaagactgcgccattgcactccagcccgggcaacaagagcaaaactccacctcaaaaaacaaaaaaaaatttaatatagcttggtaaatccagaagaatgttcagacaaagaaagcaaggatttcttgagccactagctatatgaccttagggtagttaatctctctgagcctcatccgtaaaatggggaaaatacaaactaccttatactatagttgtatttatttatttatttagagacagagttttgctcttttgccccggctggagtgcaggggggggtgatctcagctcactgcaacctccaccttctgggttcaagtgattctcctgcctcagcctcatgagtagctgggattacaggcacccaccaccacacctggctaatttttgtatttttagtagatacggcgtttcatcatgttggccaggctggtctcgaactcctgaccttgtgatctgcccgcctcagcctctcaaagtcctgggattacaggcatgagccaccgcgcctggccttagttgtttttatttttttgagacagggtctggctcagtcactcacgctgcagtgcagtggtgtgaatgtgactcatgcagcttcagtctcctgggctcaagcaatcctcccacctcagcctccagagtagctggggctagaagcgtgcagcaccatgctcagctaatgttttcactttttgtaggaacagggtcttactatgttgccctggttggtctcaaactcctgaattcaagtgatcctcccacctcagccttccaaagagctgggattacaggcgtaaaccaccatggccaacctaggatagttctaagaataagatgtgataacatatgtaagcattccagaggggtacccagcacccagtaggtattcagtaactgatagctctcattattactaactcgaaggaatggcgagtttatatggacctacctcctagtaatgaaataatctaaagacagcaggtcaaattaaacaacaaagagcattacacaaaggtgttcctaaatggtcctcttttatttggtttcagtggaggccaagaagtaggtgggcctcttaccttctgagacaggctcttcaggaacatggagacaaatactgaaaaagatggatggcctctgcttacattatacctattttaaggattacaacaaagggtatcagtcttcccaatcacagtcaagagtcaatccagtattttcactttaagtactttgaaggcaatacattcttcaagagactattatctggattgtggtatttctttataaaaacacacaaacaatctttcatcttaaaagcccgaggtgagtgtcaccacttctaagaagccttccctgaatcttccagtctaaagtcattttcctccctccaagtgccaatgaggtatgctgaacctcttttatagcagtcactacagtctattttatagcacagatttttggtgtatacaactctttgagtacaggaattgaaaaacaaaatatctttaaacctaacataaagcagtagtagcaacagcaactatctggagacaaagtaggattcttaaaatttcttttcatcctacagtgtctgctcaataaatacctgttaaattcctaaaatgtaccagatatttattcacattttcttgaatatttctagtcctccaattttccaaggtaagtagtaatattttgattttacagatcagaaaactaaaacccagagtgattcataactttatgaaagtcacacagacagacagctttcaaacccaggtccaactgtgtccaaacttcatgttctttccatgacaccacactgactctatgcaaaacacccaaactaagaagttagacaaatacgcccatagttctcatctttgtacacaagtgccatcaaattccagactagtttatctcccatggaaaaaagactgcatgctaacacaagaaagcattcctatttaccctaaaactgaaatggtgttaatgagtataacatactgctttctccctctctgcgcccaattttagccagatgctcaggggcttcacttctttcctttaaacaacataaacacaggcttatttaaaatcccagcctcagataacatgtgcagatgctactgcttttcaaactcctgttttcaaacagctaggcattaggggttccaacacttctgacgggttacttttatctacagggtccctgagaatcgctttaagtttcattctctgtttagctcatcaaatcttctcatcagggactttttttttttttttaaagcacctaatcttccatcttcttttacaatgaactaaaacactcctatgggtaattcttaatctgtgtatgtatattttaatataatattcttctctttttctaaaaagcacagttgtttttcctatttagcccaaactaagataattatatcagaagtgagttttctcccatctctttctgcatataggaaatactgaaaagataagtcttttttaattattaaatgtaaatagctcattaaatataatccaattactttaatcgtaaaaagtaattacaatatgtacatgtattctttactagatttaatatcttaatcttttcagcattaatattttaaattaacctttgacattagaaaaatgcaagaaactggtatctctttcaatatatatataaagctgttctttatggatctttgttgtgatttcacccacaaacaattttacagggaccgcaaagaggggcaattaaataccacctgcccaaactgaactggtatttcttgtctgctataaatcatgttaaagggtctgttttaaattctaatgctttagtgggacaagaagcctagagatgaattctatagcattccaaaaatcacaaaagcttcacttgtaaagacaactccaagacaaaatttgttagaagaaacgcctataatcccaaccagcactttgggaggctgaggcaggcagatcacttgagcccaggagttggaggccagccttggtaacatggcaaaaccccatctctacaaaaaacacaaaaattagccaggcgtggtggtgcacactggtagtcccagctactcaagaggctgaggtgggtggatcgcttgagcctgggaggtggagattgcagtgcgccaagattgtgccaccacactccagcctgggtgacagggtgagagcctgtctccaaaaaaaaaaaaaaaagatgaagaatgtctttggtacagtagccggaactttccattacctaattgctattctgttactatcaatcatagttccctgggaccacccgtgagcattcttcttgctctctggtctctagcccctggagtatgctgttataacattttccctcagtggccttctggttcttccatttttattttcttggtgaccaatggtaaataaattgcatagctaaatctctatcaactgccttgaaaatgggctttgacacagtatatacactgaagaatgtcttccagaatgcagggaagaagcttatataaatgaaaaattaagaagatggagttttcctaccaaaatctattaatgagtattattttaagatatgagtatttagaaaaataaaattatatttacattaacacagaactttttccaaaattcagaaatggcaagagcggcatgaatagataagctgtgaaggtatcaatgggccatgtttgtacagcagtttccctccaaattagaacagttctatttaaagtactaagacatatcatgtgttttcagcaactctcaaggatttcaatgaaatagatttttcccattcagatcttgtattaatgagccaaaggtgtacctctgcctcactgataccatttggcaaaacaaattaatgaaatggatgaggctggctgtgattaattcctttggttgttcagattgtagctatgttgcagcagctcctgactatgtaaggcactggtttctgcagtcatccagcctaactatggaaagttattttgtggtccgaaaagacagtgacatgggttgctgtgggttccctcatctcaaacactaatggattccgaacagtcacgaaagtttagctgaaggaatggagcctgatacctgatgatgatcacagtgctccagaaggacagcaccattaaaagaaaataagaagtaatttcataggtaaaaggtacacaagcagctaaaactaagtctcttgcaaaatttaaatgattcaagtttcatcttgataacactggtattttgtacaaaatatatcttattaggccagcccttgaaagttaaaaaggtgtctttaaatgcctactgacctaaaattgccatgttccatgctttaaagggattgattttctagagaaggacaatatgatgtcagattctgttcaagggagatcagaatactatttggtgaacctgttctgcacctgtggaagtaaaagaataagactggctcacacaccccgcgggaggatggtatttatatgggctctccctctgacctcttggcagcaaatgtaagaaagtccttttttgagccttaggggcgggcccaggactttcaactacccattcaaacagggttacaattcccctcctccacaattaagttcctttcctattctccatgcatgcatgaattgcagtgacattgacatgggggcttgacattagtctttgaaggtcatttaaatcatcctccttccaaactgccttaaaagcagtgtatcatccattccacaatgtctgagtgtagggtttgactagatcgtactcaaagcagaatcacctgaagaataaagagagttccaaatttgggtatcataaaaagaacaaatcaaagaaataaaaagtgatgaaactcagttactcaaaagacaatagtaaaacactaacaccgaacattggacaaatggaaacacttctactgacaatccagtttatctaggaaagtagaaaaggtcatccactggccaggcacaatagctcacgcctgtaatcccagcactttgggaggccgaggtgggtggatctcttgaagtcaggagttcgagaccagcttggccaacatggtgaaatcccatctctactagaattagtcaggtgtggtgatgcatacccatagtcccaactactcagaagggtgaggcaggagaatcgcttgaacctgtgaggcggaggtagcagtgagccaagatcacaccactgcattccagcttgggtgaaagagagagacctcatctcaaaaaaaaaaaaaaaaaaaggtcatccacaatatggccctttatatgccttcggtttcatctcctgtcacattctcatacacatatacctttctttgcagtcctacagaccttcccatcacaccccactgtaccatgttctctcttacctccatacttttgctcaagtttgaccacccaccacaacccccaccagcctataaggtcttccaagtctgagctcaagcgaaacacctcttgataggccttgccccaaaggaagctggcgtcccctcttccacatgccataacggttctctaaatatccataacacgttgtccatgtctataccatcacacgggattaaaatgagcggttttttcacttgctctcttactagactgtgagttctctgaggctgctatgagtcatctctaatcttagtgcctaccaccacgctaggtaccaagagaatggtcaataaatgtttatcaaggccaggtgcggtagctcacgcctataatcccagcactttgggaggccaaggagggccctatcacttgaggtcaggagttcgagaccagcctggccaacatggtgaaaccccatctctactaaaaatacaaaaattagctgggcatggtggcgcatgcctgtagttccagctatttgggaggttgaggcaggagaatcacctgaacccaggaggcggaggttgcagtgagctgagatcgggccattgcactgcagcctgggcaacagagcgagactccatctcaaaaaaaaaaaaaagtttatcaaatcaaatgaatgaagccatagttgcttcttgtgctttggctctcacaaagataaggataaggagggtgtctggaactccagtcttatagcactgtttcctgagagaagataacccaagttcaacctttgttttagaaatagattctggcatcccaccaggtcacgagagaggatctacatttacccctcaaactcagggtccaatctgggacagagcagaaaaagaagttgaaaattattggctgggcatggtggctcacgcctataatcccagcactttgggaggctgaggtgggcggatcgtctgaggtcaggagttcgagaccagcctggccagcatggtgaaatcccatctctactaaaaatacaaaaattagctgggtgtggtggcagacacctgtaatcccagctattcgggaagctgaggcaggagaattgcttgaatccgggaagcagaggttgcggtgagtggagatcacgccattgcactccagcccgggcaacagagcaagactccgtctcaaaaaaagaaaaaaaaaattagagaccaagactaccgtgacaacatgagtgtctgccacaaccgtctcattcttgtacctcaaagctcttactccctaatgtaaagagagaaaaatgatagttatcagccaagaagagaaatttccaaaaaggctaagaaatgtcagaataagtcatgataattagcacatgtccaaagaaatacagggtgttttaaactttccaggtacttggcctaaaatgttaataagaccctgaatctcccaaaccagcttcttgtcttcctctcctcaatacttttgtcccacccatctacccaccaagctgtctgcctttcttttttccctctcccagactcttttttgttttttttgagacagagtttcactcttgttgcccaggctggagtgcaatggcacaatctcagctcatcacaacctctgcctcccgggttcaagcgattcttctgcctcagcctcctgagtagctgggattacaggcacgcgccccacgcctggctaattttgtatttttagtacagacggggtttctccatgttgcctaggctggtctcgaactcctgacctcaggtgatctgcctgccttggcctcccaaagtgctgggattacaggtgtgagccatcgcacccagcctccttctcccttcttttctgttcccttcccttctcctcccttccctcccttcttcatttctttcctcaataaatatgggtagagctggtgaaaatctggcacacaaatgacaactatgaaatatatatggagccaggcatggtggctcacacctgtaatctcaacactttgggaggccaaggcaggaggatcacttgagcccaggaatttgaggccagcctaggcaacatagtgagatcccatctcttaaaaagaaaaaaaaaagcatacatatatattgtctttgtataaagtaatatacaattatttgttcattcagtgaaacttatataccaggcactgtgccacacacttaggatattaatttaatacttcctctgccctcacagagcttgcaagctcctggagatataaataaaggggacaataatactctggtaagtgtgactacaaatgttaagttcaaggtataatggaagtatccagctcaagttggggcaaagaggggcagtcagttaagaaaaggtgtcttaaaggacaaataaagctagttaagaacttccaggtggagggagtagcatatgcagaggcaaaaacagtgttccaggaacagtaaatggcttatgtggctgaagtgcaggaagtcatgagtgatgagactaataaggcagacaaaagctgaggcacagagagccttgtatgccgggctacagcacttaacagagtgtgctaaaagctatagggagctatttaagattgaggccagagagtgacatgatcagatttgcatttagaaagctctctctggcagcagtatggagaatgtactacatgagggagtgaaagactaaggcagaagtccaagtggaagcatttctaattgacagaatctacagaacaggagagttgcaaaacaggatgctacaaagtgtgctatactgggtttgaaagaccaggtacactttcttccttgaacaattaaattacagtagtcaccccttatcctcagaacatagttccaataccctcagatgacgcctaaaactgcagatagtactgaggtgtatttttttctatacatacatatgataaagtttaatttataaattaggcacagtaagacattaagaacagtaatagaacaattacagtaatattagtaaaagttaagtgaatgtggtctctcaaaacatcttactgcactgtattcacctgtttttgaaccagagtggaacacaggtaattgaaactggataaggcaggagaccactgtatttaatttctctgagcctcagtttttactttttgaaaaatgtgtttatttgcaaaagaagaactagggagaacactaggctagatcaagtgtcagcaatcttttcttaatgctttaaaattatttagagatatagtttttaaaaaaataggccagacgcaggctgcgcgccgtggctcacgcctgtaatcccaacactttgggagaccaaggagggtggatcacgaggtcaaaagatcaagaccatcttggccaacatggtgaaaacccatctctactaaaaatacaaaaattagctgggcgtggtggtgcgcacctgtagtcccaactacttgggaaactgaggcaggagaatcgcttgaaccagggaggcagaggttgcagtgagctgagatcgtgccactgcactccagcctggtgacagagtgagactgtctaaaataaataaataaatgaataaataggccagacgcggtggctcgtgcctgtaatcccagcactttgggaggctgaggtgggtggatcacctgaggtcaggagttcgagaccagcctggccaacatggtgaaaccccatctctactaaaaatacaaaaaattacccaggcatggtgtcacacacctgtagtctcagctactcagcaggctgaggcaggagaattgcttgaacctaggaggcaggttgcagtgagctgagatcacaccaccgcactccagcctgagtgatagagtgggactccatctcaaaaaattaaaataaaaacaaaaatttaaaaattaaaaatatatgtaaactctaaagactcatgatatagcaaatgtcagtgtatctatcactgtttaagaagaatattgccaggcacggtggctcacgcctgtaatcccagcactttgggaggctgaggtgggtggatcacctgaagtcaggagtttgagaccagcctggtcaacatggtgaaaccccatcactactaaaaatacaaaaaattacccaggtgttgtgttacacagctgcagtctcagctactcagcaggctgaggcaggagaattgcttgaacccacgaggcaggttgcagtgagctgagatcacaccactgcactccagcctgagtgacagaatgggactccatctcaaaaaattaaaataaaaattttaaaaattaaaaatatatgtaaactctaaagaatcatgacatagcaaatgtcagtgtatctatcacccagtttaagaagaatactgccgggagtggtggctcacgcctataatcccagcactttgggaggctgaggtgggtggatcacttgaggtcagcagtttgagaccagcctgggcaaaatgatgaaaccctgtgtccactaaaaatacaaaaattagccaggtgtggtggtggacgcctgtaatcccagctactcaggaggctgaagcaggagaatttcttgaacccaggaggcagaggttgccgtgagtggagatcactccactgcactccaacctgggtgacagagcaagactctgtctcaaaaaaaaaaaaaaaaaagggccaagcgcggtggctcacgcctgtaatcctagcactttgggaggccaaggcagaaggatcatgaagtcaggagattaagaccagcctggccaacatggcaaaacccagtctctattaaaaatacaaaaactagccaggcatggtggcacatgcctgtaatcccagctactggggggctaaggcagaaggatgcttgaacctgggaggcagaggttgcagtgagctgggatcacgccactgcactccagcctgggcaacagaccaagactctgtctcaaaaaaacaaaaaagaatattactattagccttaaagccccctgcatactctcccaaagccatctcctttccttatcctgaaataactatcttaaacgtgtgacgtgtgtttaccatttcctttactttatagttttatcacatttctatctctaaatgttatattgtttagtgtcacattctagaacttcatatgactctaatatatatacatatatatgtgtatatatatgtgtgtatatatatatgtgtgtgtgtgtgtgtgtatatatatatatatatatatatatatatatatattttttttttttttttttttttaaagatacagggtcttactttgttgtccagactggaatgcagtgcatgatcactctttgtaacctgtaactcctgggctcaggcaatcctcctacttcagcctcctgagtagctgggaccacaagcgtgtgccaccatgcccaactaattttttttttttttgagactgttttcctgttgttcacggtgaagtgcagtggtgcaattacagatcactgcagcctcaaactcctgggctcaagagatcctcccaagtagctgggaccacaggcaggcaccaccaatgcccagctagtttttaaattttttgtagagacagggtcttcttacgttgtccagggtggtctcgaactactgggctcaagggatcctcccgccttggcctcccaaaaggctgggattacaggcatgaactactgcgcccagccacttttaaaatttttttgtagagacagtgtctcactatattgcccaggttggtcttgacctgatttttttatttctaatattaacgtatatacccttctgcaactttttgttcttgagattagtttatgttgctatagctgcgatttactttttcactgctatatagtattctattgtaggaacatatcatgattaacttatccaatctcaagttgatcgacattgggattttttctccagtttgaattttctgttagtttgttttgctattgtcaacagtgttgctatggatgtttttgtacatgtctcctggtccacatatgtaaagttctttagggtaaatacccaggagtggaatttctgggtcacagggcatgtacatctttaattatgagacaataccaaattgtttttccaaaatggttgtgctcatttacacttctgcttgcagagttctagttgcttcacatccttcccaacattttttgtcagactttaatttttaccaatctgatgaacataaaaccaatatatcactgcagttttaatttgcattcctccgattactgatgaggctgagcaccccaccccttttcataggaaggagttactttttgtttttccaaaacactgagatcaagctctctccatgaaagtctggaatggctagagtatgtgccagcagctgcctcctaataattaaccagatgaagtctggtctctttcagcactaaggtaaaactgtatgaccaaatctctggcatatatcaacacatgacatagcaggaaacctgaaaatttttatctgagaattgggggtgggttagggatgtgagaagggccgagactgagaaaaatcagactaggaatgatcagagagaatgtgttatttaaggcccttcactaactgacacgaacatacttgtttagcctcatctctggccacacctttccaatgctctagcctgcagccactcactgctcaccacagaagccctgcactccaatgtctctgtgatttcactcaagacatttgccacttcctggattacttacctttttgtttttttcctgcttcttagaatgtgattaacgcttcccggcccagttcaagtgtaattgcttccatgaagctatcctgaccccattccccagaaaaaattaatcaagctttcatctactccaagagaactctattattactttattatagaatccatcccatattacagttggaacacgaagactgtgagctctttgagggaaggtactatcttttaaatcctgtggtgctaagcagcccttctgtcactcatcaaatcttcataaaattcctgataaatggacagaaagatgaacataaatctactgggaaacaaatctctaaacagtgaaaaggttaggatgggtgcagtggctcacacctgtaatcccagcactttgggaggccgaggcaggcggatcacgaggtcagaagatcgagaccatcctggctaacacaataaaaccccatcgctactaaaaatacaaaaaattagccaggcgtggtggcgggcacctgtagtcccagctactcgggaggctgaggcaggagaatggcgtgaacccaggaggcagagcttgcagtgggctgagactgcaccactgcactctatcctgggctacagagcgagactctaaaaaaaaaaaaaaaaaaaaaacaacaatggaaaggttctttctgactcttgcagactatgaagaaaaaaaatcagagaaaaagcaaggaaggagataaggagtaggagctaatgaaaaagaaaacaggacaactgggtccccttagtagaggtccatatcagataggccaggaagtaaaaatgtaaaccatagttcaccattttaatgtaggggacaacaacatggaaagtgaaatttagaactgattttaaaactataggctgtatcttgaaagtgatcaaatttaactggaaaattatttggatattccctagtggttaggaataaataaataaatacataatttggtcatggtgctttcctctggaagaagttaagtaaaacttccatttatttaatagttaaaggttttctcttttttttttttttttttggagacagagtctcattctgtcacccaggctggaatgcaatggtgcgatctcagctccactgcaacctccgcctcacgggttcaagtgattctcctgcctcagcctcccaagtagctgggaatataggcgtccgtccgccgccacgcccggcaattttttttgtatttttagtagagatggtgttttgtcatgttggccaggctggtctcaaactcctgacctcaggtgatctgcccgtctcggccccccaaagtgctgggatttacaggcgtgagccaccgggtcctgcctgtatttttttctagtagagatggggtgtttcaccatattggctaggctgatcttgaactcctgaactcaagtgatccacctgcctcggcctccgaatgtgctgggattataggcatgagccaccacgtcagaccaggttttctatttttttcttacatcatcttggtaagttatcttttcctaggagcttgtccatttttatgtaagtcctcaaattaactggcacagtatttattaaattgattagtagggtcgggagcagtggctcatgcctataatcctagcactttgggaggctgaggcaggtggatcccctgagctcaggagttcaagaccagcctggacaacatgatataactctgcctctacaaaaacttacaaaacttagtcaggcatggtggctgacgcctgtagtcccagctactcagcagactaaggtgggaggatcacttgggcccaggaggtggattagtaaaaattattgttattaagacaaaacggatagaagaatggaagaatggaataatggcagagtataatccagacataaagatctgggattcaacaatattgtgacctttttttttttttttaagagacggggtcttactctgttgcccaggctagagggctgtggcttaatcatagctcactgcagcctcaaactcctgggctcaagtgaccctcttgcctcagcctcctgagtagttaagactataggtgtgagctacctctcctggctaatttttaaaaatttttgtagaaattaggtatcactattttgcccaggctggtctcaaattcctgggcctcaagcaatcctcccacctttacctcccaaagtgctagggttacaggcataagccaccacacccagcctaatatttcaatattttaacgtatctctgtgttctcagaatataggtttcttttggacaggagattgtgtcttttgcacacactgtgttgtcaaaagtatttgttggctgggcgcggtggctcatgcctgtaatcccagcactttgggaggccgagacaggcggattgcctgagctcaggagttcgtgaccagcttgggtaacacagcgaaactctgtcgctactaaaatacaaaaaaaaattagccaggcatggtggcctgcacctgtagtcccagctccttgggaggctgaggcaggagaagtgcttaaactcgggcggcggaggttgcaatgagccaagatcgcgtcactgccctccagcctgggtgacagagcgagattcttaaaaaaaaaaaaaaaaaaaaaaaaaaggccttgttgatttcctatgtcaaataaaaaacataaaattggtaattcaaggcaaataggtatttattttattattttaatagttcattttcattaatgcatggttgatcccagttaaagataacaaatatttgtagttttcctcaaaaataaagatttttaaaaattaagtaaaaattaggtcgggggcagtggctcactgtaattccagtgctttgggagatcaaagcaggtggatcacttgaggccaggagtttgagaccagcctggccaacatggtgaaaaaccgtctactaaaaatacaaaaattagttgggcgtggtggtgcatgcctgtaatcccagctgcacggggtgctgaggcaggagaattgcttgaaactgggaggtggaggttgcagtgagccgagatcacgcctctgcactccagcctcggtgacagagcgagattctgcctcaaaaaaaataaaaaattaaaaaattttttttaaaaaattgtaaaaattggcagccgagcgcagaggctcatgcctgtaatcctagcactttgggaggctgaggcaggcggatcacctgaagtcaggagtttgagaccagcctggccaacatggtaaaaccctgtctctactaaaaatacaaaaattagccaggtgaggtggcaggcgcctgtaatcccagctactcaggaggctgaggaaggggaatcacttcaacccaggaagcggaggttgcagtgagccgagatcacaccattgcactccactgggcaacaagagcgagactccatctaaaaaaaaaaaaaagtttcagaggccattctcatttgtgaattttttgttgttgttgagacctggccgtgcctgtcatgcagtctgcagtgcagtggtgtgatcatacctcactgtagcttcaatctctcggactcaagtgatcctcctgcctcagcctcccaagtagctaggaatatgggtatgtgccatcatacctggctaatttttaaaatttttagtagggacaaggtctggctatgttatccaggctggtctccaactcctgagctcaagtgatccagcctcctaaagtgctaggatttacaggcattgagccatcctgctgggccacattcataaatctgacataaataaaacatctatccttttaaatataggaattcactgaatttaaagaaaacagccaccaagaataggaaatttaaacagctttgaactataaaatatacattatttttaaaaaataaaaatgtaatcaagactattattactataaaagtacatctcataatttaaggggaaagtcattttagtggtttaaaaaaaacttatgttcacatgtgttttatccattcttcctccaaactttataccacagtagttaactggtaggaaggctatctgatataaatttcagtgtccttgcctgtcccaccccctatcaccctagtggatacatacttggttaaatacatactgtataaggaagcaaaaaggtagtttgatctttaaaaatccacaatagattctattagaataattttgaaagtttagcgatttgactacaaatactagccctctatcaatgaaggacaacctctaattggacgcagcttcagaacagtgttactgcaaataagtataacagatcaatgagataacacatatgctttgattctagactggtataatcctttttaacaaacattaacacagcctctagtaccatacaataaggttatttccaagtatctataggaagttgatgacagtaatatttctctgccagtccagtaatgcagatgcatttaccagctcctctccttgtagaaatcctgttaataaagatattttgggatttatggttttaaatgccaattttttttttaatgggacaagtgttatagaaattcctgctggtatttttcagacttggaggaaatgaagtttgacaaagaatatttcctgagtggtctggagggaagtaaaagaattagcaaaatcgagagaatatgaaaatgaatcaggtaaaggcctgagttctgttggcgaaagaaaaaatgcacctgtattatgtaaataagaatccatggtaaacaagattcaattataatgaagcaattatcatgtcctgtcacatttgtgaaaactaaactctgccaagaggtatcctttcagggtgtccattcaccttggtttacatcaatcatcccagagtgattattaaaagtattttctctcactcttaaaagtgaaccagtttacacattatatgatcaccctatccttgaagaaccaggaggcagagctattaacatagccccatgttcagcgtccaatcatagtcccatagccaaaatggagtacagatatacctcatttatctaacactgtgaatagagcaaaatagtcctataattcagaacatgaattctgaaaccaaatgacctgggttcaaatctcagctctgctaaatatactcttcagctgtataaccttagaaaagtttttggccaggcgcagtggctcacgcctgtaatcccagcactttgggaggccgaggtgggtggattacgaggtcaggagatcgagaccatcctggctaacacagtgaaactctgaaatcccgtctctattaaatatacaaaaaattatctgggggtgtttgtgggcgcctgtagtcccaactactcggcaggctgaggcaggagaatggcgtgaacccgggaggcggagcttgcagggagcagagatcacgccactgcactccagcctgggtgacagagcaagactccgtctcaaaacacaaaaacaaacaacaaaaaaaaggtttttactttttattttgaaataattgcaaacttggagaaaagttgcaagaatattacaaagaattctcatatacccttcacttaggttcactaactgctaacattttgccacatttactttacacatctctccacacacattcacatacacacacagaattaattaattaatgaattaattaagacagggtctcactctgtcgcccaggctggagtgcagtggcgctaccatgactcaatacagccttgacctcccaggctcaggcgatcctcccacttcagcattttttttttttttttttgagacggagtctcgctctgtctccccggctggagtgcagtgacgacggatcttggctcactgcaagctccgcctcccgggctcactccattctcctgcctcagcctcccgagcagctgggactacaggcgcccgccaccacgcccagctaatttttttttttaaatttcttatttttcgtagagtcggggtttcaccgtgttagccaggatggtctcgatctcctgacctcgtaatccacccgcctcggcctcccaaagtgctgggattacaggcgtgagccaccgcgcctggcccacctcagcctttcaagtagctgggactacaggtacacaccaataggcctggttattttttgtatttttggtagagacagggtttcaccatgttgcccaggcagtctcaaactcttgggatcaagtgatcctcccaccttggcctcccaaagtgtggagattacaggtctgagctaccacacacggccactcactattttattactttttttttttttttttgagatggagtctcgctctgtcacccaggctggagtgcagtggtgcgatctcggatcactgcaacctctgcctgccaggttgaagcaattctcctgcctcagcctcccaagtagctgggactaaaggcacatgccaccgttcccggcgaatttttgtatttttaatagagatggggtttctccatgctggccaggctggtctcaaactcttgacctcgtgatctgcccaccttggcctcccaaagtgctggaattacaggtgtgagccaccgtgcctggccctattattaattttttaaccatttgataataggttgtagacatcatgtcctttctccaaatacttcaatgggttattttctaaaaacaaactacagttcaattatcacattaggaaatttaacaataacacactattattatctaatgtaaagttcgtatcttttacccgttgtctcactaatgctcttgaagaaaaacaaaaaaagagagagagagatggggtctctctatgttgcccaggctggtctcaaattcctgggctcaagcgatcctcccatcttggccttccaaagagctggtatgacaggcatgagccaccatacccttccctactaatgctctttatggaaaatttttccctcaacccagaatcccaataaagaatcttgggtagatttcttaacctctctgtatatcagtttccccatctataaattggagattaataatagcacctacttcataagattattgagaaaaatgaaagagtaaatataataaggaatttagaacagttgctgatattcagtgcaggtgttagctgcttttatttttattattttaatttttttttttagatggagtctcactctgtcgcaatggtgcgatctagactcacggcaaccttcgcctcctgcgttcaagcatttcttgtgcctcagcctcccaagtagctgggattacaggtgcgcgccaccatgcctggctaattttagtatttttagtagtgacaggatttcaccatgttggccaggctggtcttgaactcctgacctcaagtgatccgcctgcctggacctcccaaattgctggaagtacaggcatgggccactatgcctggccgttagctgcttttagagaatggcagacttcatataaggtaaaactgtcagataatggaaataattatttagagactatgctttttgaaggtattttaatgaaaatctgtaaaatatattgtgcatatcaattattttctgaacagaatatattatagatattttaactttttcttagaaactcagggtcttcacatctgcagtggtactgctataaaactgtgatactggccggatgcggtgacacctgtaatcccagcactttgggaggctgaggcaggcggatcttgaggtcaggaaatcgagaccatcctggctaacacggtaaaaccccgtctctagaaaaaatacaaaaaatcagccgagtggtggcgggtgcctgtagtcccagctactcaggaggctgaggcaggagaatggagttagcccgggaggtggagcttgcagtgagccgagatagcgccactgcactctagcctgggcgacagagtgagactctgtctcaaaaaaaaaaaaaaaaaaaaaaactatgatactgtcagaggcacctgaggtgtgaggtttacatatgcctatatagtaaaatgtctgcaaagttctggacagacaacttgaatctcttgtctgctgtcctgcttctgatcattagtatatattaacatgcctcctttatattattattattatttttttttttttttgagacagagtttcactcttgttgcccaggctggagtacaatggcaggatcttggctcaccgcaacctcagcctcccgagttagctgggattaaaggcatgtgccaccacgcccggctaattatgtattcttagtagagacagggtttctccatgttggtcaggctggtctggaactcctgacctcaggtgatccgcccacctcagcctcccagcctcatctatattattctaataataattttggtcatacaaagcttctagtttaaacagtactttcagctgggcatggtgactcacgcatgtaatccaagcactttgggaggccgaggcgggtggattgcctgaggtcagcagttagagaccaacctgaccaacatggtgaaaccccatctctactaaaaataaaaaaaattagctgggcatggtggtgggtgcctgtaatcccagctattcaggaggctaaggcaggagaatcatttgaacccaggaggtagaggttaggttacagtgagccaagatcacaccattgcactctagcctgggcaaaagaggaaaacggtctcaaaaaaaaaagtactttcatatctttcattaattcaataaatatcatttgattaattagctgatatgaatcttacaattagtctgtgaggttaaaaaaaaacatatattactactcccaattttaactacctaattatagacaaataaattaaagctcaaagaggtcaaatgacactttgggccacagagtcaataggccacacagtcagccctcatacacctgggtcctctgtgtgtcaatatacacaattatctgagtgaggtcctgagctgatgctactgttgaagtaaaatgaacaatctttaccacttagaagcacttccagcttacttttatatttatttatttgtttattcattttgagacagagtctcgctctgtcgcccagactggagtgcagtggcacgatcttggcttactgcaacctgtgcctcctgggttcaagcaattctcctgcctcagcttcccaagtagctgggattacaggcgcgtgccaccacgcccggctaattattgtatttttagtagagacagggtttcaccatgttggccaggctggtcttgaactcctgactttgtgatccacccgccttggcctcccaaagtgctgggattacagcctttacttttattttttatttccgaaagcagcaggagaaaaacagcttacttttaaagacgcaaggaaacacattctgactggctgagactgccagatgtctgactttcagatgctgttcctctttacttctcaaatatctttctaaaattctctgaacgctacagccacactttattaatatagactccacacatgaaagttgagatatattcagaactgagctgaagtttacctctgcactctaataaagactaagaaaacagtgtaaataagattgcagggagaaatgtttaatgagctgtttttaagcatttcaagtctaatttacatacaattaaagttaatttgcacaccattctcagctattcattaaaccaggtacaaggatctctatctaacaaaataacctggtaacactattagcctagtttcaattactgtatgaactcaaagtaacagctgcatctaaagaaaaataacctacaacactctcactaggttttcccccaattagcccaaattaatgaggtttaatactacctccatgatgacccacaaaacctatcttcccctgatgacccctacagtataagctaaaatgtagttaaaccacctgtcctagagactaggcagaggaagcaagacaaaatggcaatggctaaggaaggctacggttctagggcagattacggtactaaatctgtgctaccttagttaaatcactcaacttctcttgccttcagctgcctcttttacaaaatgagggagctaataatgtggtctctaaacacaatatcgcaataagaggatccagagcttaggggaaagggcagaaaatgtacaagatgagttgggaacacattatcgtgctagaaagcaaggaacactatcaaagactgctgaaattatgtcaaaaggaatcaggagctagcttgaagaacttcccactggtccaatatgaaacaaagttaacatcaataagaataactgcaatggattaaaacacatcaaatatgttaacacctaaaagttcctgatcatgccctaaaaaaccctaaaaagtcactggtcctctctggagtatatctgaaaaccaactcattattttgaaaactagtaaatgaaagaataaagggaatgaattaagtatttaccttgccttccttgtacatatcaaaccccagggtaaccaaagagttgataaagtaaactttttcttttttgaagtattccagatgataaacaacaacaaaaaagaatgatagaattaaaatctaatcatttttcacacatttaatgaaatcatggatctaggtaatcatcatccatgaccacgtacaacagaaaaagagacatctggacattatgagcctcctcacagaataatacaccaccacttatgaagtattattgccaaaaaagcaaccggattcagttcaagcctctagaggagcactgcacaacaggagccactgcatacatgcagctatggagcaccaaaaccagggccactccaaaccgatatgtgccgtaagtgcaaagcaccaactttcaaagatttaatattaaaaaaggatgctgctgggcgcagtggtgcatacctgaaattccagcctttgggaagctgaggtgagaggatggcttgaggccaggagttcaagataagcctgggcaacataatgaagcccgtctctacaaataatttaaaagttagctgggtgtggtggtgcatgcctgtagtcctagctacttgggaggctgaggtgggagcccaggtggttgaggctgcaatgagctgaaatcatgccactgtactccagcctgaaaaacagagtgagagctcagctcaagaaaaaaacaaatcacaataattttttattgattatatgtcattatattaatgttaaaataataagacttttcaggctggggtgcggtggctcacactggtaatcctagcactttgggagaccggggcaggcagattgtttgagcccaggagtttgagatcagcctgggcaacatggagaaaccccatccctataaaaaatataaaaattagctgggttggtggtgcacgcctatagtcccagctacttgggaagctgaggtgggagggtcacttgagcctgagaagtggaggttgcagtgagtcgagataatgccacactgcactacagcctgggtgtcagagtgagaccttgtctcaaaaaaaaaaaaaaaaaccaaaacacacacacacacacacaaagaaaaaaataatagtttgcaactattgggtaaaataaagtttttcgtttgtttgttttctgttttttttttttgagatggtgtccaggctggaatgcagtggtgcaatctcagctcactgcaagctccgcctcccgggttcatgccattcccctgcctcagcctcccgagtagctgggactacaggcacctgccaccacgcccggctaactttttggattttttagtagagacggcatttcaccgtgttagccaggatggtctcaatctcctgacctcgtgatccgcccgccttgacctcccaaagtgctgggattacaggcgtgagccaccacgcctagccaaaataaagtatattattaaaatgaatttccggggggcgcagtggctcacacgtgtaatcccagcactttaggaggccgaggtgggcggatcacgaggtcaggagatggagaccagcctggctgacacggtgagactctatctctactaaaaatataaaaaactagccaggcgtggtggcacgcgactgtagtcccagctactggggaggctgaggcaggagaatcgcttgaacccaggaggcggaggttgcagtacatcgagatcacgccactgcactccagcctgggtgacagagcaatttcctgtttcttcttatctttttaatgtgccaaataatttttttttttttgagacagggtctcactctgtcgcccagtctggagtgtagtagcacaatctcagctcactgcaacctccacctcctgggttaaagcaattctcgtgtctcagtcacccaagtagatgggattacaggcacatgccaccacaagcagctaatttttctgttttagtatagatggggttttaccatgttgaccaggctgaaattttaaatttaattagaagcttgaatatttctgttagacaacactctctagatctaacaaccagtttatagggaataaaagggatagaggaatataaatgaattacagaaattcaactagcaaagtccagaacgggagaattacacaactttgtttctttaacaacagcagcaataacaaaaaaaaaacaccagagaaaaaaagaactgaccaggcgtagtggctcacgcctgtaatctcagcactttgggaggccgaggcaggcggatcacctgaggtcaggagttagagaccagcctgaccaacatggtgaaatcccgtctctactaaaaatacaaaaattagctggtcgtggtggctaatgcctgcaatcccagctactcaggaggctgaggtaggagaatcatttgaacctgggggacagaggttacaatgagccgagattgcgccattgcactccagcctgggcgacaagagcgaaactccgtctccggggaaaaaaaaaaaagaactgagagaacctgtagattaaaaaagacgtaaaagaggccgggcacggtggttcacgcctgtaatcccagcactttgggaggccaaggagggtagatcacctgaggtcaggagttcaagaccagcctggccaacatggtgaaaccccgtctctactaagaatacaaaaattagctgggtgccgtggtggaggcggaggttgcaatgggctgagatcgcgccactgcactccagcctggcaacagagtgggactctgtctcaaaaaaaaaaaaaaaaaaaggagacatagaagctatgtaaaccaaatcaatgtatcaaccttgtctgaaacctgattcaaataaaccaaatgttcagagagaaggggtggcagggatgaagggagagcagaaagagaaattaattgtggaaatttgaacattaacaggatgcagtgtggttatgttttttaaaaacagtctctttattttttacagctatacacagaaattagcatttaaatgatatgatgtctgggacttgtttcaaaatgatctaagggggatgagggaacgaataggggtatggatgaaacaagactgaccatgagctaataattgttgaagctgagtgttgggcatgtaaggcctcactatatcaccctctccacatctgtatatgtttgaaattttctatacttttctaaagaacgagatgagcagacaagtttatctataaaaacttcttgtagcttttgaatctacaaaaatgtatgaaaataagtcacagagttggctaatacttcaagagatcattcgatctagtgtaccgcctccaggacacactacaacattatcacattcagcaaatatttattgagtaactattgagcacaaaggcgctaacattgtagaagatgcacagaaatacaagaaccagtttctgtttcaggactttagtcatataggagaaatcagaaaagtacctaaacataaaacaaggtaaaaagtgatgaagttgaccaagcgcagtggctcatgtctgtaatcccagcacttcgggaggccaaggctggcagatcacctgaggtcaggaattagagaccagcctggccaacatggtgaaaccccatctctactaaaaatacaaaaattagccaggtgtggtggtgtgcacctgtagtcccagctactcgggaggctgaggcaggagaatcacttgatcccgagaggcagaaaggttgcagtgagcagagatcgcaccaccacactccagagtgggcgacagaatgagactctgtgtcaaaaaaaaaaaggtgaagttacggtttaagtatcataagcaaggtagtttttaagtatatcagaagccatcatagaagagtgtcatataactgggcatgaaaaataggcaggatttggacatgtagtgacagggagtattatatctgaagtgtacagacagtgtcagcagaagcacaaaggcagaatataatgaaacatttttgggaaatgaagatgagcgcattattgcgcctgtagtgggaaacagagctggaaagacaagtaggggctagaccacagaatcttaaatatcaggctgagtttgtactttagtcaataagcattgggagtcacacatttggagttctagatgatagaatatttaggaagaaactatacacctcacctaagtttagtagaaaagaatggagctggggagggggatgaaaataaggataaataatcaaggcaaaaggtaacacaggacctaaaatgcagtagtgggaggaaaagacagggagggatctgagagtgtctgggcatgaaaacaagcaggagttgagaagtcaacagtaactaagattttacaactggatgaactgggagaatggtggggccaatgtttagcatgttggcagacctataccagccctgaatagtgttcaataaatgactgactgactgaataaataaatagaaatatgtgagtcaaaatgaagagcagtaagtcaggggatttggggggctggggagtggggtgggcaggagataagctgaaccttctcattgaacctgtgttcctcacaaggttctgaagaacaaaatgctgcccaggagtgctatgcattttcttgggaatgcacttctctaaagcaaaggactcatcattaaaacctacataaaaggtataaaacccatccttaaaaccagtaaacatgcctcccaagcaaggaggagacaacctgtacaatctgaccacaggttctcaaaagcagacagctcatgaaaagctggaggtgcaagtaggatatcagtgaagcggtccaataggaattctggtactggagctgagaggcaaaaatatagatgtggcagttactgcatgaaggttgtaacagaagacataagagtaggctgtgggccgggcgcggtggctcacgcctgtaatcccagcactttgggaggccgaggcgggcggatcacgaggtcaggagatcgagaccatcccggctaaaaacagtgaaaccccatctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactctgtctcaaaaaaaaaaaaaaaaaaaaagagtaggctgtgcacagagcctcaaacctgtgatcccagcactctgagaagctgtgacggaagaatcgcttgagtccatgagttcaagacccttggctccacaaaaaataaaattagctgggcatggtggtgtacatctgtggtcccagctacttgagaggctgaggtgggaggctcacttcagcccaggaagctgaggctgcagaaagccgagatggcgccactgtactgcagcctggccaacagcgcaagaacctgtctcaaacacacacacacacaaagagtagatgacctctcaatacaaaagcaaaaaaaagagaagcaaggcctgagacaacttagggactgacaaaggaggatcaggaaggcagaaagagaaccagaacaatgttgtgtcataaaagctaagagaagaatgtccagaaggaaggcctgttcaatccttatcttcttccttgacccacaaattcaacccatcaacaagccttatcagctctacctccaaaatatatactaaacacatccatttctctccatctctttagcgacctacctagtagttcaaactttcatcactgcctagatttctgcagtagcctgttcaacccacctcaatcaagtcctgcccccaaataatccactctctttgtagcaactggattaatcttttaaaaatggaaatcagggccaggcgcggtggcttatgcctgtaatcgcggtactttcagaggcagaggcgggcagatcacgaggtcaggagatggagaccaccctgcccaacatggtgaaaccctgtctctactaaaaataaaaaaattagccgggcatggtggcgggtgcctgtaatcccatctactcgagaggcaggagaattgcttcagcccaggagactgatgtggtggtaagctgagaccacgccactgcactccagcctgtgtgccagagcaagacgccaactcaaaaaaaaaaaaaaaaatgtaaatcaaaactgggtgcagtgatgcaagcctgtgatcctagcactttgggaggctgaggcaggtggatcacttgagctcaggagttcaggaccagcctgggcaacatggtgaaatcccatctctacaaaaaatacaaaaattagccaggcatggtggctagcacctatagttccagccacttggaaggctgagatgggaggactgcttgagcccaggaggcagaggttgcagtgagctgagatttcacgactgcactccagcactccagcactccagcctgggtgacacagtgaaaccccgtctccaaaaaaaaaaaaaaaaaaaaaaaaggggaaatcaggccagggtggctcatgcctgtaaccccagcaccttgggaggccaaggcaaggattgcttgaggccaggagttcaagaccaatctgggcaacaaagcaagaccccatctttaccaaaaaaaaaaaaaaaggaagaaaattagtatggcatgaagatgtgagcctgtagccctagctacttaggaggctgaggtgggaggatcccttgagcccagaaattcaaggctgcagtgagccatgatggcaccactgcattccagcctgggagacacagcaagaccttgtctcaaaaaaaaaaaaaaaaaaggaaacaaacaacaaaaaaaattgtgctttatagggcatgatcatgaaaagtgaaaagacaacccacagaatgggagaaaatctttgtaaataatttatctgataacctgtatccggaataaagaactattaaaatacaataaaaggacaaataacccaattttaaaagaagcaacagatttaaatagacatataaatagccaataaatggccaagagcggtggctcatgcctctaattccagcactttcagaggccgaggcgggcggatcacgaggtcaggagatgaagaccatcctggctaacatggtgaaaccccgtctctactaaaaatacaaaaaattagccgggcgtggtggcaggtgcctgtagtcccagctactcgggaggctgaggttgcagtgagccaaaactgcaccactgcactccaccctgggtaacagagcaagactccagactccatggccaaaaaaaaaaaaaaaaaaagaaagaaaaaaaaagttacattgttaatcatggaaaaaattgtaacagaggaggaaagaggggtattggaagaaacaacacagtaagtcctcacttaactcatcaatagattcttggatattactattttaagcaaaacaatgtataacaaaaccaattttaccacagtctaatgtaaacaagagttaagttcctatagcatatttctggtcacaaaaaacatcaccaaacttctaaagaaagaccaaaacacttccaatattaaacactgaaacaaatgtgagctacacaaacatttaagaaagattaataaaaacaagaaagataagtatttacctaattattccagttcagggtcatgggtggccggagcctgtcccaacagcccagggagcaaggtgggaaccaactctgggcaggatgccatcccatcaatcacacacgcacccacactcactcagactgggaccatttagagacaccaattcatcaaacacgaacaattctgtgatgcgggaggaaaccagagtacctggagggaaaccaaagtactggagaaagcccacacagatgtggggagaacgtgcaaactacacagacagtagccccggccaggaatacattttttttctcatcaacattataacgcaatgaaggtgaacaaaataatgttattcaaagacctgttgtaatggccatgagttgatacttgttgaggctaggagatagatacataggagttcattacatcattctctttacttacatgtatgcttgatattttttcattaaaaagttttttttttaaatcttcaagcacctcaatttaaaaacaaaacacttcttccagacttcccatttacttaaaaataaaacacacccaggcaaagtagctcacacgcctgtaatctcagcactctgggaggctgaagctgaggatcacttgagcccaggagttcaagaatagcctaggcaacatagtgagactccatctccataaaaaataaaacaattaggctgggcatggtggctcacacctctaatcccagcactttgggaggctgaggtgggcggatcacgaggtcacaagatcgagaccatcctggccaacatgatgaaaccccgcctctactaaaaatacaaaaattagctgcgcatggtggcatgagcctatagtcccagctactcaggaggctgaggcaggagaatcgcgcctaaacccaggaggcagaggttgcagtgagccgagatcatgccactgccctccagcttgggcaacagagcgagactctgcctcaaaaaaaaaataaaaataaaaaataaaacaattagcctggcatggtgacctgcatctgtagtcccaagtacccaagaggctgaggtgggaggatcacttgagccacagaggttaaggctgcagtgagccatgatcgcaccactgcactccagcctaggtgacagagtgggatcttgtctcaaaaacaaaacaaaacaaaacaaaatacacacaaaactcctggccagatgtggtggctcacatctgaaagcccaccactttgggaggctgaggcaggaggactgcttgaggccaggggttcaagaccagcctgggcaacacagtgagatgcaatctctacacataaaatttaaaaattaggcaggtgtggtgttatgtaactgtagtcccagttacgcaggaggctgaggcaggagttcaaagctgcagcgagccaagactgtgccactagcctgggcaacagagcaagaccttgtctcaaaatataaataaacagaactccttaacagtcctaaaaagctttgaaatatctggctcctacccatctctccaatcacatattttgttaccaccgttcactaatacatagccatggtaggcttccatcactctcaggatacactaaggattttcctgattcagggcttctgccatcaacagttccttctccctggaactctcttccctcgtttctctatttcaatggttcattttcattcttcactttcagtatatcaccttctcagagaagcctttcctgaccatccttatctaagttcctctattactctctattatagcaccctattttattttctaacatacatcacaatctttaactttttatgtctttttgttttgttctgttttgtttgagagagtgtctgcctctgttgcccaggctggagtgcagtggcataatcttggctcattgcaacctctgcctcctgggttcaagtgatcctcccacttcagcctcctgagcagctggtactacaggtgcacaccatcacacccagctaatttttgtattttttgtagggatggggtttcaccatgttacccaggctggtctcaaactcctgggctcaagtgatctgcctacgttagcctcccaaaatacttggcctcacgcctccccatgtgggcgtgagccactacacccagccttatttatgtctttactgtctatccaaggcttcccaaactgcatgagagcatgcaccttgtttcttctcaagatcactgagttgtatccttagtagtacgtgacacacagtaggcacttaacacatctgttgaatgttaaactaataacccaatactaggcattatcctattgttgaatgtttaatatagcaaaggcttacagaaaacctactgtttacgaggccttaggtaacacatatacacatctgatgagaaggtaaatggtgtcttaggccattcttgcattgctataaagaaatatctgagactgggtaatttataggcaaagaggtttcactgctcacagttctgcaggctgtacaggaaacagtgccagcatgtgctcctggggaggcttcaggaagcttttactcatggcagaaggaaaagcgcaagcaggcacttcacatgtgaactcagagcgagagctcacttatcaccaaggggatggcccaagccattcatgagggacctgcccccatgacccaaacacctcctaccaggccccatctccaacactgggtattacatttcaacatgagatttagagaggatacatattcaaactacatcacatggtataatgagaattaagtggacaaaatttaaaaaaaaaaaaacctcttccagaggcttctgaaaagagcaaataagtagactatttttcccccagagaattcatttaaaaacagaaataagagagttgtgacacagtcccttctctaaagatgtataaacaaagggtccccaagggatcaaggctgaaatgtaccacaattaacatttttagaaattatctagaaaaaacaatagtgaaatcttcccagtttgcagatgactctacagcaacacatagaagtacaatggtgcaaggctctgtgtgttcagcaatgtgaaaaacagcttccatgtagacaaaaataaggtaattcagtgacagaaaaatagttcaaactataattatcaaacgatgagctctaaaactacctgttttaacataggaaaggggtttcaaagtccctagactgtaccctgaatacagctacaaaaaggcaacaaaatactggctgtcattatgaaagctttggaaacacagaacatattatcctatccttgtacaaaccaaagtgtacctgtacctagaatagaatgtgtagttgtagtcatcatagcacaaaaaaggtaaaatagagaaggcctagaaagatatcacagaagaccaaagggaccagaggggcttctatatgagtacagattttttttaaatgtctttttaaggccaggcgcggtggctcacgcctgtaatcccagcactttgggaggctgatgctggcagatcacgtgaggccaggagtccaacaccagcctggccaacatggcgaaatcccatctctactaaaaatacaaaaattagctgggcgtgttgacacatgcctacaatcccagctactcgataggctgaggcagaagaatcacttgaaccaggcaggtggaagttgcagtgagcagagatcatgccactgcactccagcctgggtgacagagcaagacttcgtctcaaaaaataaaaaataatctgttgcaatgagcaagtattacttttgtaacttcaaagagattttaaaaataaataaatcggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggctacagagcgagactccgtctcaaaaaaaaaaaataaataaataaaaaaaaaaataaaaataaataaatctaggatattagaaatgggaggcaggccgggtgtagtggctcatgcctgtaatcctagcactttgggaggctgaagcaggtggatcacttgaaaccaggagttcaagaccaacctgaccaacatggtgaaacccccgtctctactaaaaagagacttgggaggctgaggcagaagaactgcttgaacccgggaggcagaggttgcagcgagccgagatcctgccactgcactctaacctgggggacagagggaagactctacctccaaaaaaaataaaaaaggaaagaaagaaaagaagtagaaaataaatttcatgcaaatagcaaagcaaaaaaaaaaaaaaaaaggatatgatgtaagaataagcaaattagtagctgtggtttgttggaaagaactctagatatgcatcaaaggacttgggttcgtatacacattaacatggacaaatgtgaaaaactttatgttgaacagaaaaagtcagacacaaaagtgtgcatactatatgattcaagaataggtaaatttaatatgtggggatagaaatcagaacattggttgcctataaaatggtggagattgactggaaggggaactggaaggagggaactttggagggttataaaaatattctatttctttttcctttttttgagatggagtttcactcttgttgcccaggctggagtgcaatggcgtgatctcggctcactgcaaactccgcctcccaggttcaagcgagtctcctgcctcagcctccagagtagctgggattacaggcatccgtcaccacacccagataattttttgtatttttagtagagacagggcttctccatgttggtcaggctggtctccaattcccgacctcaggtgatccacccgcctcgacctcacaaagtgctgggattacaggcgtgagccactgcgcccagccaaaatgttctatttcttgatgtgggtgttggctacataggtgtttacatttgtcaaaactcgtctaattatatacttccatctcactgtatataagttttacctttaaaaatcttggttagggccgggtgtggtggctcacgcctgtaatcccagagctttgggaggccgaggtgggtgaatcacaaggtcaggagttcaagaccaccctagtcaacatggtgaaaccccgtctctactaaaaatacaaaaaattagccaggcgtggtggcaggcacctgtaatcccagctactcgggaggctgaggcaggagaattgcttgaacccgggaggcggaggttgcagtgagccaagactgcgccactgcactccagtgtgggcgacagagtgagactccatctcaaaaaaaaaaaaaatcttggctaggcttggtggcttacacctgtaatcttggcagcaccttcgaggctaaggtgggaggatcacttgaagccaggggctggagaccagccttagcaacatacccacacctcatctctattttattatttaaaaattccaaataattttaaaataaatataaatctcatcttaaaaaagacatttcaatttcaaatgttccattatttagttgaataattttgaggaagttaatctctcagaaccagtttactttatctataaaatgcagctactaatggcctggcacggtggctcacgcctgtaatcccagcactttgggaggccaaggcgggtggatcacctgaggtcaggagttcaagaccagcctggccaatatggtgaaaccccgtctctactaaaaatacaaaaattagctgggtgtggtggcacatgcctataatcctagttactcaggaggctggggcaggagaatcactggaaccagggaggcagaagctgcagtgagccaagatggcgccactacattccagcctgggtgacagagcaagactccgtctcaaaaaaacaaacaaacaaaaaagtagctactaacatatctcaagtgctggggactgtctgtaatagtatacaacaaagtggagcactatgctttgcaaattatcatccaatgaatgctgaaggaactttaaaagtaaagatagggaagaagttagtcttataattctcataattccacagatgccgttggtattcaggaatactattctttaaagactatcaatattctacaaagggaaattcacttatagttcccaattgtgaatgaaaaggagtatcaataggcatgacccaaaaccttcttctacacagttaaacaaaatttctcaagacctgatttaagagcaaactttttaaactgagtacttatggccgggtgtggaggctcatgtctgtaatcccagcactttgggaggccgaattgggcagatcacttgaggtcaggagttcgagaacagcctggccaacatggtgaagccccatctctactaaaaatacaaaaattagccgagtatggtggcaagcacctgtaatcccagctactcgagaggctaaggcacaagaatcgcttggacccgggaggcagaggttgcagtgagattagatagcaccactgcactccagcctggaaacagaatgagactccatctaaaaaaaaaagaaaataaaaataaaataaaatataataaaatagaaataaactgagtacttgctagaacaaaggcataagccaggtatggaggaaggagaggaggtttcaaatcaaaatacttgagagtaaatgaactgctcttgttactttactatgtcaattacaaagcttaaaattcacacaagccacacgacatatttaagaatgcatgtgttgggccaggtgcggtggctcacgcctgtaatcccagcactttgggaggccgaggcgggtggaggtcaggagatcgagaccatcctggctaacacggtgaaaccccgtctctactaaaaatacaaaaaaattagccgggcgtggtggcaggcgcctgtagtcccagctactcccagctcctccctgtagtcccaattactcgggaggctgaggcaggagaatggcgtgaacctgggaggcagagcttgcagtgagccgagatcacgccactgcactctagcctgggtgacagagtgagagtctgtctcaaaaaacaaaaacaaaaaaacaaaaaaagaatgcatgtgtggaggtcaggagatcaagaccatcctagcttacatggtgaaaccccgtctctactaaaaatacaaaaaaaaaaaaaattagccaggcgtggtggcacgcgcctgtagtcccagctactcaggaggctgaggcaggagaatcacttgaacctgggaggtggaggttgcagtgagccgagatcacgccactgcactccagcctgggcgacagagggagactccgtatgaaaaaaataacgcatgtgtgtatacacatacacatgttcactcaaattggaaatgagtcaaaccactgctttttctcaaaaagccttctgtattctcaaaataagaaacttggggccaggcgtggtggctcacgcctgtaatcccagcactttgggaagcagaggtgggcagatcacttgaggccaggagtttgagaccagcctggccaacatgacaaaaccccgtctctactaaaaatacaaaaattagccaggcatgggggtgggcgcctgtaatcgcagctacttagctcaggaggccgaggcaggagaatggcttgagcctggggtgagcagggagggcgtgcacagaggctgcagtgagccaacatcatcgggccattgcactccagcctgggcgacagagcaagactccatctcaaaaaaaagaaaaaagaaaaaaaaagaaactattttgttcaaatggaattaatcttacagctgagagtacatctcagacttctctgtattttaccagaaagaaaaacagagcttgaaaagaaatatcacaggcaaagtttaatagcctctcctatcaatctcaaattatttattagtctggaaatcatcatgaaaagcaaatttttctgagatacttctatatctgaacattatttcttcagcaagcattcaacaattcttgtttctattcttctcttttctaattcaattctgtttggtttctaagttaagaagtgtgtttcatttgcataaatggtaactattctgagatactattcataactatacatttgaattctgtaaagtaccattcataacttcaaacagaacaggaaaaaacactcattcaactttaccttaatggtgactaagacatgaatgattataatgttatattgtacagagttggccaaaagagaatgaagtcttcaaatgttaccactaccttgtcattaatttatgaatgcccagaggaattaaggaccactgccttgaccaatccgcctgtcacaaaaaatactgagcttagaaaagcatgcccattctaaacatgttttttggagttatgaagtgtttatgcggggacatcaagagatacatcttagccatgaagctcaaaaattagcaagaatcctgacaagttctggcaagttctttatataagcaatgctggttatcctttaagtgttaaacttttcagctatgagcttttcttagaaacagtctttcatgcaaggtaggtagtaatagtccagtagttctttactctatgtaatcttaatcagtggtagaaattaaatttacatagatctgcataaataattcagctatctgtcctgctctaatatatttaaaccaaataaaataaaacttgaacagaataaaaataatggggctatttttaaatggtcacctcctgatttttctcattttcttatccaaagtcagggacaggaactgcataaccagaaagaaggagaaaaaggagaacatgcacctgaggacatctataatcactttcctctattgctccaccactcctacccctattgatacagtagctcacaacagggagaaatctatccccccaggataaaagtaacaatatctggagacatttctggttatcacaactggggcagagggggtgctattggcaaccagggatgctgcttaagtattcctggtcggaccatgaaatggaagaggagcacacaagaatgaagcagaatacaaaggccataattaaagcagtattagtatctcacgcctgtaatcccagtactttggaaggccgaggtgggcaaatcacttgaggtcaagagttcgagatcagcctggccaacatggtgaaaccccatctctactaaaaatacaaaattaggccgggcgtggtggctcacatccataatcccagcaatttgggaggctgaggcgggtagatcacctgaggtcaggagttttagaccagcctgaccaacacggtgaaaccccatctctactaaaaatgcaaaaattagccaggcatggtggcacatgcctgtaatcccagttactcaggaggctgaggcaggagactcgccctgaacctgggaggcagaagttgcagtgagccgagaccatgccattgttctagcctgggcagcaagagcaaaactctgtctcggaaaacaaaaacaaaattagccaggcatggtggcacgcacctgtaatcccagctgctactaggtaaggctgaggcagtagaatcccttgaacccaggaggcagaggttacagtgagccgagatcacgccactgcactccagcatgggcggcagagtgagactccatctcaaacaacaacaacaaaaagggggtgaggggtctgggcatggtggtttatgcttatccctgtaatctcagcactttagggggccaaggcagcaggatggcttgagctcagtttaagaccagcctgggcaacatagttagacctcgtctctaaaaaatttaacaaattgggtgggcatggtagcgctcacatgtagtcccagctatttgggaggctaaggcaagaggaggactgcttgagcctaggaggttgaggctgcagtgagtgagctgtgatactgccattgcactcaagccagggcaacagagtgagaccctgtctcaaataataacaataatttttcccattccctagtccaatcacacactgactccacctgcaactcttgatacagtttcttatcctttgtatctccaaaacagtgaaggtaccattcttaggaactatggagccaccccaagtaggtggctgaattcaggccctcaaaccaggcagctacttggtttcttaaaggacaaaattccacaaatccatgctgtcatggggctttcttctaaagagaaaaaataattcttcatcctccaacaataccagtccacctcactctacagtagagatgtccgagaaaactaagagtagcctgagttttgaaaatgtgctagtagaggcccttggccatttaaagaaaccacccaaattcatatggctggtaaacagaagtttctcatatagcatacacttaaaataaaaatactcaaaattaaatgtattttagtaaactccttacaccaagatgtgcaaattgtggaagcttcataaattaaaaataaacaaaattttgacccaaatcccattgacagtttttacctcattctaaagaatactctaggccgggcgcggtggttcatgcttgtaatcccagaactttgggaggccgaggtgggtggatcatgaggtcaggaaatcaagaccatcctggctaacaaggtgaaaccctgtctctactaaaaatacaaaacaaaaaattagccaggcatggtggcgggcacctgtagtcccagctactcgggaggctgaggcaggagaatggcgtgaactcgggaggcggaggttgcagttagccgagatcacgccactgcactccagcctggatgacagagcgagactctgtctcaaaaaaaaaaagaatactctaaaggaaaaaaatcagctttaaaatttggcaaacatggccgggtgtggtggctaatgcctgtaatcccagcactttgggaggccaaggcaggtggatcacctgaggtcaagagttcaagaccaccctggccaacttggagaaaccccgtctctactaaaaatacaaaacttagccgggcgtggtggcagacacctgtaatcccagctactcaggaggctgaggcaggagaattgtttgaacccaggaggcagaggtagcagtgagccaagattgcgccattgtactccaggctgggcaataagagcgaaacttggtctcaaaaaaaaaaaattggcaaacatgaatctacagatctgcatttgatttgtttttctctgaattatatgcaaaaagtacaattctcttaaatgctatacaaaaaatgatgagcaaagaccctacaaattactatttaaagaagaggtgggggcagggcatgaagtctcacacctgtaatctcaacactttggggaggccaaggcgggaagatcacttgaaggcagaagtttgagaccagcctggcaacatttcgagagcccatctctactgtttaaaaaaagaaaaaaagaaaataaaagaaataaaatttttaaaattaaaaacaaaagaggtggagggtgtcattctaaaatttcagagactagtgaagatattaaagcataaattgtggtacttaaggaaaaatgcttatcaggcacattttaatcacagtaagatttctgtatgacagaaacaacaaaaggtgtctgtcttctatgtaatattgtttttaggacacatgactttgaaattaactggactatacaatatttttccttgtaattgctcttgttatcatgtaattttgtttgtttgtttgagacagagtcttgctctgtctcccaggctggagtgcagtggcgtgatctcagctcactgcaacctccgcctcccggattcaagcgattctcctgcttcagcctcctgagtagctgggattacaggcgtgcaccaccacacccggctaatttttgtatttttagtagagacggggtttcaccatgttggtcaggctggtctcgaactcctgaccttgtgatctgcccgcctcggcctcccagagtgctgggattacaggcttgagccaccgcacctggcctatcacgtaagttttacctatagagatctacagtcccttcactttatctgcaaaatgcaaaggctgtgaaaaataaatttttcattattcatttggaggcaaaacctgacaagaaatgacataaggctaatgacagtacagtatttatcccagttagtatgaacatccagacattttactacagaaataataaaatacatctgatttaaaaagtgctgccctgacctctctggggtattacataacacatagtaccatatttcttttctaaaaccccaaaatccaaaaatttttaaattcagatatacatttggtcccaagaactttttttttggtgccaaggattttgaataaggtactgtggaccggtatactaattaagactaattattttacagaaaatataacatattgggaatgaatgtattaatagagcttcacgtgcaataaattcagtgtcttcacaactatcacatacacacaatcctggaaaataacgcataaaaagacttaacatgtcaaaagccaaacacattattatgtgtttttcaagtgacggtgatatttgcatcctctaatatctagatcaattccttaggttgaaatcacagttaaaatatagctaaagactcagctgggcgtggtggctcacgcctgtaatcccagcacttccggaggccgcagcaggtggatcaaccgaggtcaggagtttgagaccagcctggccaacatggcaaaaccctatctctactaaaaatacaaaaattagccaggcgtggcggtgcatgcctgtagtcccagatacttgggaggctgaggcaggagaatcgcccgaacctgggaggcggaggttgcagtaagccgagatcacgccactgccctccagcctgggtgactgatatatatataatatatagattatattttacatatataactcatacattatagatgatatatattatatataatctatatatttacatataatctacatttatatattatatataaattttatatataatctgttacatatattatatataacatatatataaaatatagattatatatataatataatctatatagagagatttttttttgagacggagtctcgctctgtcgcccatgctggagtgcagtggtgcgatctcggttcactgcaaactccgcctcccgggttcacaccattctcctgcctcagcttcccgagtagccgggactacaggcacccgccaccacgcccggctactttttgtatttttaatagagacgtagtttcaccgtgttagccaggatggtctcgatctcccgacctcgtgatccacccgcctcggcctcccagagtgctgggattacaggcgtgagtcaccatgcccggcctataatatatattttatataaatatatatatttaatatatatacaaatataaatatatatttatataaatatattttatataaatatatattatataatattataatatatgttatattatatatattttatacaatatataatatatattatatatattttatacaatatataatatatattatatatattttatataatatataatatatattatatatattttatacaatatataatatatattatatattatataatatatattatatatattttatataatatataatatatattttatacaatatataatgtatatcattatattatataatgtatatcatattatataatgtatattatatattatatatttattttatattcttattatgttatacatatattttatatataagaccaaattagtaatatgctgagaaaaagaataatccattgtaaataatttactcaataaaatgctctgatttttaaacaactattctcagagggtttaagatttaaaattatttcattctagaagaaaactgaacaaattacaattgactttttctatgaaagtagagcctgggacatggatagagacaggaacagctcttaaagatatctgaacaggaaaaagtttcacagttctttccttccttcctcctgtagttgctgcttttctggttttagaatttcaaacaaagaaatacatactggctccactgctaagaaacgccctctttctcagtaacttcctcttccaattttcttctccactactgacatatgagaacaatacccatagccgtccctactattctgattaaccaaaagctctgaggtttggaaaaattaagggcagcaagttattgcacccaactaccgcctaccccaaatccacaatcttcactcattagaagtcaaaaaacaggttgcacaaagaaagggatattaagcttaatcagaggtgggctattgaacctttcacccaagaaatccaaagaaatttgaacaaatgggaaatttctcccatcccaagaaaatgtggccctctgatggaggagaagaagcgaatgggctggcaccactctgaaccaaagtctagtctatatacaccaatagctgctgaactttttctacaggcaaccctaccaggattcaaatggagctctctgaggtcctgacacacacttcaaagggacttttacgacttacaaatagttctttccaacttacagactgaataaaggggctggacttataattaaccttccagagatcaagactgtccccatgccagaagtcaaatcacatatctgaggccagacctctgcccccatttgtaacaaggcaaacttccctaacactatcttttgagtgggcagtgacttcccccttgcccagtgattctcagaggaaacaatttagttaagtaacctctgccctttactgtgcgaccttgggcaaattacttaactcctctgaaactcagtttccttatgtgtaaattctcaagagtcactgtaaaaaaataagaacatatgcctaagcaagggttgacacctagtagggctgccataaaagttcttcctcttccttctaaccctcctgaattctggacctaaattccaatcagagccccaaggggctccaaggagtccttcctcttctccggttctatggacaaccatattaaaactttccctctcagaggctctaggattcctggagaaccaagaggaccccagctcaccccatcatggtctgggtagcacccacgtcctccttggaacagcccctttagacaactctcctccttactctgcagactatcctgtacgcgcgcacacacacacacacacacacacacacacacacacacagtgtcctcctcaatttagcaggccggggcctcaacgagcacctcaattacttcatggtacacacacacacacacacacacacacacacacacacacacacagtgtcctcctcaatttagcaggccggggcctcaacgagcacctcaattacttcatggtacgtacacacacacacacacacacacacacacagtgtcctcctcaatttagcaggccggggcctcaacgagcacctcaattacttcatggtccagagatggaaactgaggctcagcctggggaagaacttgtccaagatctcagacaacagctgggacccaactcctgtacatacatctgccgacgaaaccctcgttttacacagggggtaaactaaggcctagagaggaaagtgacttgctcaagatcacacagcgagctgatggcagaaccaggtcaggccgggacactcatagtccctcagacttgtggacccctccaagtttccgaaggggacttcgggtcactccctccctccctgagggggtggggtggactaagacgccaccccgcgctgaccgctcgcccggcctctgccagtccgcagtaggagtcccggcacccagtcccccgagaccctgcacggctcgggaagagcggcccggccggggcccgcgcctcccagcggggtctacccaaggggacttgttgctcacctggcctcccgcagtcgccgtcagcgacaggaagggtcggccggccgcccagtctccgcacagagtgtgctcccgcggaccgcctcgcgggctgccaaacggccggaccccctcagcgcgctacgcccccagccgcgctcgccctgcctgtgtccgccattacgcgattccccgccctgggc

SEQ ID NO: 172 - DNA, 85946 bp, Homo sapiens; identical to SEQ ID NO: 171

SEQ ID NO: 173 - DNA, 38398 bp, Homo sapiens
tcgccgagctgggccaatcctcttggtggaggaagctcggctgattctcggctcacgcgggaggggagtaaagggtggcggtccgggcctggagttcagtgggtgcagcctgcttgcgagctgaggccagacaggggggcgcctacggacgggtaagagtcgtggccttgccattggaggtcaccctgtgtcagcgactgggcagtgcgggagggtggggagctacggggtcgcccgggtcgggtgctttctgggttgacctaaggctgagtttagggaccgagtgcatcagagcagccagaaacgattaccttgcgtgttggagcagggactgtactcacggggcaactgagacccggagaggggaaggggtgtgctgagtgttgtcgcagaggtcggacggctgggacctaggaactgaatccagccgaggctcgctctttgagggtggcccttcgagagcacccctagactgacccagatgtataggccccagaccaggttccaagagaggatcactttagatcttacctggctaaaagcagcccaggacggtgaactggggcctttgggaacggactttgaaaggagtgagggggatgtgagcgagcatgaggggcggggagaggtcatcaaaatatactctttttgacacccacacaatgcagataaggaggagcattccaggccgagacgccctcatcagcagagtcacaggagttttggaagtgagaggtatgcttggagaattaaaagggagcgtgtgcaagggctgtggactgacatagacctgcagaagtggagctggaggtccagtttgccctctttagctatccccgtggcttttagccttcacctgtttttcctccaggcataggggcagtaatctagggagacagagggcagagagtaagtttctcagacagagaaaggcccgaggcttattagaaccttttaaatggagctgctgccctttgccctcttctctcttcagcagtgaacagattcctgacttttgggtcatcatcatccccccaagtagtacgagccagagttctcactgtgatctccaaagcttggcacgacgtgtccccttccatcgctccacaactcttctctcgtctggctcactccagccccagaacactggctttgtggttgaacctcatgtgccagccacactcctgcctctcatctttgtctcagttgtcctctccgcctgcctcctcttaggcaccctatttaagtattgcagcccccagtacaaacaagccactcaccttgctctacttttttttccaacagttcttatccccttctgacctactgtatattttgcttgtttgttttgctctttgttgtccctccactagaaggcaggctgtctgagggcaggcatctttgttgtattcactactggtactccaggacctagaacagagaggggcacatattagacaactgatgagtagctcccctgtttcccagctctcacctagctagtcctccctgctctaccaggttaatcttcgtagtgaacggccctggtcagggcatctccctgctcttaaaccttcagagcctgaaccgtaaagggctccttagcctggcctgtgatccctctgcccagttttgcccctggtaacccttctagcttaatgtccctccataccttgcttcccagtccgtcaacctgcagatcggaagcctgacagagtacaagggaaaaacacaagttctgcgcaggctgtgtgcaggctgtgtgaccttgggcaagtcgcttaacctctctgagcctgtttctcatttgttgagtgagaccagtactgtctacctgatgggatacttttgcatctcaatgggatgaactacttatatgtaaagtggcctgatgttgagcaggtcttcaggcagtattacagttgacccctgaacaacatgggtttgaaccttgtgagtccatttacaggcagatttttttctcatctctcccaccgctgagcagcaggatcagctcctcctcatcttccttctcagcatactcatcaggaagaccgtgaggatggagaccatgatgatccactttcactcagtgaatagtaaatatattttctcttccttatgatttcatagtaacattttcttttctctagcttaatttattgctgggacacagtatgtaatacatgtaatgtacaaaatatttgttcatcaactgtttacattattggtaaggcttccagccaacagtaagctatattagtgaagttttaggtgagtcaaaagttatatgtggatttttgacttcggggctccgtgcccctaacccccacattgttcaagagtcaaatgtagttcttgtctctgatttgctcttgtcattcccccccgcccaccatgcctggagccttagacttgtccaaaatctcttccctgcactgcagccaaggtgatctttccagtcgcaacactcactcctgcttccaacttctaggggctccaccatctttccccccttgtaactccctagcttggcacacagcccccacatgttctcaactttgctcccgatcttgcttcacacttgctgtgacacagcttgtcactgttataagaacatgctggctctgtgccatcactttgtccttcccaccctggccatggaatgtctttcaggacaccatgcgctctgttttactcactcttctggggccttttgaagtcagcttagggatctcctagttggggcaggcttccctgagccagcagcctgcattggtgctctgggcttgccctcatcagagtggaaacgcacttctgtgactctttgcttgctcctgtctcccaccctagatggcgggctccttgaaggttggcagtgtgtctttgtcagcttctgcctggtagtggctggcatttgataacttgtgaatgaggaaatcaatgcatgaggtgacacctgggggttcttttacaagttacagctcccgctttaaccctgggggtttgtttgagcctcacagtagctctgaggtagggaagaaggacgctgttttacagataaggcctcatggccagcggcagcacgataattcactcaaacccatcttccattccaggctgtctgctgggcctccaggggctcgtggtgtcctacagggtgctgagtgtgaggatgagagcagaaacaggtgctgtggaagcgactcaccttccctggggagggggaggaagtttcacagagggggcagttcagctaggccttgaaggaagaggaggcactcaccgtggagaggagagagaaggtattccatgcagaggaacagcgtaagctaagctcacaggcatgctgctgggtttctgagaggtctaccacaaaataaaagctggcgactttttttgtcctaaaagtaaatagagaaacaaacaactggtggaaacatggacaccgcaggtccgtggaaggacaaggtcaagctgggttgccccagcataatcaaggctaaagtgacacctctaaagagaaatgacctccaagctattggcctcactaatcctaatctgggtattttctttcccatatcacatctttgaattctgaaagggaggctttattgttgttcctacagggctcctgctttgctgtattttctctaagaaatatgtccataatgaaggtgtgtgccgcctcaggtgaatccttctctttgcatctgatcatctggcccagtcctgcagaggaggccaagcatgaggcatgaggtgatgggaaataggggaatcctcttttataatccaaggcttaggcccccatttcaggattccaaagaaagttctaagaaacattacttggcattccttggatagccaaactctactgaggtgtttggggaagggcagtttgcctggcattgtctgcccatggactgaagggatgagctctcagtggccacattctagcttcctgcactggaccttgtgcaagggtggggctccgacaacctttcccctttacaaagatgtcacacttctttctagaaggacgggacgctctcatctctctccctagtttgagacagaatgttctctccttttccctccaggaaatgttccccagcaggaaggaggaggttgggctaactcgcttctctcttctcgcttcacatgaggcggcacacaccttcattatggatgtgtttcttagaaaaaatacagcaaagcaggagtcctctaggagcaaacgtaaggcctccctttcaagatgtgatatgggaaagaaaatactcagattaggattagtgaggccagtggctacaaggtcacatctctctttttttttttttaattattattatactttaagttctagggtacatgtgcacaacatgcaggtttgttacataggtatacatgtgccatcttggtttgctgcacccatcaactcgtcatttacattaggtatatctcctaatgctatccctcccccaggcccccaccccccaggccccagtgtgtgatgttccccgccctgtgtccaagtgttcttattgttcagttcctacctatgagtgagaacatgtggtgtttggttatctgtccttgtgatagtttgctgagaatgatagtttccagcttcatccatgcccctacaaaggacatgaactcatcatttttcatggctgcatagtattccatggtgtatatgtgccacattttcttaatccagtctatcagtgttggacatttgggttggttccaagcctttgctattgtgaatagtgccacaataaacatatgtgtgcatgagtctttatagtagcatgatttataatcctttgggtatatatacccagtaatgggattgctgggtcaaatggtatttctagttctagatccttgaggaatggccacactgtcttccacaatggttgaactaatttacactcccaccaacagtgtaaaagtgttcctatttctccacatcctctccagtatctgttgtttcctgactttttaaagatcgccattctaactagtgtgagatggtatctcattgtggttttgatttgcatttctctgatggccagtgatgatcagcattttttcgtgtgtctgttggctgcataaatgtcttcttatgagaagtgtctgttcatatcctttgcccactttttgatggggttgtttgtgtttttcttgtaaatttgtttaagttctttgtagattctggatattagccctttgtcagatgggtagattgcaaacattttctcccatcctgtaggttgcctgttcactatgatggtagtttcttttgatgtgcagaaactctttagtttaattacatcccatttgtttattttggcttttgttgccattgcttctggtgttttagtcatgaagtccttgcccatgcctatgtcctgaatggtattgcctaggttttcttctagggtttttatggttttaggtctaacatttaagtctttaatccatcttgaattaatttttgtataaggtgtaaggaagggatccagtttcagctttctccatatggctagccagttttcccagcaccatttattaaatagggaatcctttccccatttcttgtttttgtcaggtttgttaaagatcagatggttgtagatgtgtggtgttatttctgagcgctctgttttgttccattggtctatatctctgttttggtaccagtaccatgctgttttggttactgtagccttgtagtatagttcgaagtcaagtagtatgatgcctccagcttcgttctttttgcttaggattctcttggctatgtgggctcttttttggttccatatgaactttaaagtagttttttccaattctgtgaagaaagtcattggtagcttgatggtgatggcattgaatctataaattaccttggacagtatggccagtttcacaatattgatttttcctattcatgagcatggaatgttcttccatttgtttgtgtcctcttttatttcgttgagcaatggttcgtagttctccttgaagaggtccttcacgtcccttgtaagttggattcctaggtattttattatctttgaagcaattgtgaatgggagttcactcatgatttggctctctgtttgtctgctattggtgtttaggaatgcttgtgatttttgcacattgatttggtatcctgagactttgctgaagttgcttaaggagattttgggctgaaacgatagggttttctaaatatataatcatgtcatctgcaaacagggacaatttgacttcctcttttcctaattgaataccctttatttctttctcttgcctgattgccctggccagaacttccaacactatgttgaataggagtggtgagagaggggacccctctcttgtgccagttttcaaagggaatgcttccagtttttacccattcagtatgatattggctgtgggtttgtcataagtagctcttattattttgagatatgtcccatcaatacctaatttattgagagattttagcatgaaaggctgttgaattttgtcaaaggccttttctgcatctattgagataatcatgtggtttttgtctttggttctgtttatatgctggattacatttattgatttatgtatgttgaaccagccttgcatccctaggatgaagcccacttgatcgtggtggataagctttttgacatgctactggattcagtttgccagtattttattgaggatttttgcatcgatgttcatcagggatattggtctaaaattctctttttttgttgtgtctctgccaggctttggtatcaggatgatgctggcctcataaaatgagttagggaggattccctctttttctattgagtggaatagtttcagaaggaatagtaccagctcctctttgtacctctggtagaattcggctgtgaatccgtccggtcctggcctttttttggttggtaggctattaattattgcctcaatttcagagcctgttattggtctgttcagggattcaacttcttcctggtttagtcttgggaggatgtgtgtgtccaggaatttatccatttcttctagattttctagtttatttgcatagaagtgtttatagtattctctgatggtagtttgtatttctgtgggatcggtggtgatatctcctatatcattttttattgtgtctatttgattcttctctcttttcttctttattagtcttgctagcggtctatcaattttattgatcttttcaaaaaaccagctcctggattcactgattttttttgaagggttttttgtgtctctatctccttcagttctgctctgatcttagttatttcttaccttctgctagcttgtgaatgtgtttgctcttgtttctctagttcttttaattgtgatgttagggtgtcaattttagatctttcctgctttctcttgtgggcatttagtgctataaatttccctctacgcactgctttaaatgtgttccagagattctggtatgttgtgtctttgttctcattggtttcaaagaacatctttatttctgccttcatttcgatatttacccagtagtcattcaggagcaggtttttcagttttcatgtagttgtgcagtttttagtgagtttcttaatcctgagttctaatttgattgccctgtgtctgagagacggtttgttgtgctttctgttcttttacatttgctgaggagtgctttacttccaactatgtggtcaattttggaataagtgtgatgtggtgctgagaagaatgtatattctgttgatttggggtggagagttctgtagatgtctattaggtctgcttggtgcagagctgagttcaattcctggatatccttgttaaccttctgtcttgttgatctgtctaatgttgacagtggggtgtgaaagtctcccattattattgagtgggagtctaagtctctttgtaggtctctaaggacttgctttatgaatctgggtgctcctgtattaggtgcatatatatttaggatagttagctcttcttgttgaatggatccctttaccattatgtaatggccttctttgtctcttttgatctttgttggtttaaagtctgttttatcaaagactaggattgcaacttctgcttttttttgctttccatttgcttggtagatctctcttcatccctttattttgagcctatgtacgtcactgcacgtgagatgggtctcctgaatacagcacactgatgggtcttgactctttatccaatttgtcagtctgtgtcttttaattggggcatttagcccatttacatttaaggttaatattgttatgtgtgaatttgatcctgtcattatgatgttaggtggttattttgcccgttaattgatgcagtttcttcctagcattgacagtctttacaatttgtcatgtttttgcagtggctggtaccagttgttcctttccatgtttagtgcttccttcaggagctcttataaggcaggcctggtggtgacaaaatctcccagcatttgtttgtctgtaaaggattttatttctccttcacttatgaagcttagtttggctggatatgaaattctaggttgaaaattcttttctttaagaatgttgaatattggctcccactctcttctggcttgtagggtttctgccgagggatctgctgttagtctgatgggcttccctttgtcggtaacccgacctttctctctggctgccctttacattttttccttcatttcaactttggtgaatctgacaattatgtgtcttggagttgctcttctcgaggagtatctttgtggcattctctgtatttcctaaatttgaatgttggcctgccttgctaggttggggaagttctcctggataatatcctgcagagtgttttccaacttggttccattctccctgtcactttcaggtactccagtcaaatgtagatttggtcttttcacatagtcccatgttatttggaggctttgttcatttctttttactctttttttctctaaccttgtcttctcactttatttcattaatttgatcttcaatcactgatatcctttcttccaattgattgatttggctattgaagcttgtgcgtatgtcatgaagttctcgtgccatggtttttcagctccgtcagggcatttaaggtcttctctacactgtttattctagttagtcattcatctaaccttttttcaaggtttttagcttccttgcgatgggttagaacatgttcctttagctcagagaagttttttattaccaaccttctgaagcctacttctgtcaacttgtcaaagtcattctccatccagctttgttctgttgctggcgaggagctgtgatcctttggaggagaagaggcacgctggtttttagaattttcaggctttctgctctggtttctccccatctttgtggttttatctacctttggtctttgatgttggtaacctacagatggggttttggtgtgatgtcctttctgttgatgttgatgctattcctttctgtttgttagttttccttctaacagtcaggtcactcagctgcaggtctgttggaatttgctggagctccactccaaaccctgtttccctgggtatcaccaatggaggctgcagaacagcaaatattgctgcctgatccttcctctgggagcttcgtgccagagggtcacccgcctgtataaggtgtctgtcggcccctactgggaggtgtctccagttaggctacatgagggtcagggacccacttgaggagcagtctgtcctttctcagagctcaaacgccatgctgggagaactactgctctcttaagagctgtcagacaaggacgtttaagtctgccaaagtttctgctgccttttgttcagctatgccatgcccacagaggtggagtctatagaggcagtaggccttgctgagctgtggtgggctctgcccagttcgagcttctcagccactttgtttacctattcaagcctcagcaatggcggacgcccctccccctccaggctgcagcctcacaggtggatctcagactgctgcactagcagtgagcaaggctccatggccatgggaccctccgagccaggcacaggagagaatctcctggtctgccagttgctaagaccgtgggaaaagtgtagtatttgagcgggagtgtcccgtttttccaggtacagtctgtcacggcttcccttggctaggaaagggaaatcccccaaccccttgcacttcctgggtaaggcaacgccgtgccctgctttggctcaccctccatgggctgcacccactgtccaaccagtcccaacgaggtgaaccaggtacctccattggaaatgcagaaatcacccatcttctgtgtcgatcacgctgggagctgcagaccggagctgttcctattcggccctcttggaatgaactgagttcacatctctttagaggtttcagtttagccttattttgctgtggcagctcagctcaactttgtccttccatgggcctgtggtgtggggcaaggtggttggatttcaccagtacaacatatctctgttttcctatattatttttagcttaagattttgtcccagtgtacatcgtgggtgcacatattggtttttaatggattcaaataactaacattttaaaggaagagacttgaggcttctgatgtgtgaaccataacaatccaccagcccctaaaacattgctctttggagtcttgttttcagtagttcagagctattcttctgtatgtctgtgtggtaaagtagacataacagaaaatgtaccatcttcaccatatttaggtggacagttgagtggcattacatgcattcccattgttgagtgaccatcaccccatccgccttcagaactcttttcctcctgcagcactgagagtctgttcccatcagcagtcactccccactcacagagcatttgtccttttgtgtctagcttatttcactgaccataatgttctcgaggttcacgcatgttgttgcatgtctcagaacttcattcctttttatggctgaagaatatgcccgtgtgtggctagaccatattttgtttatctgttcatctgtcagtggacacattgctgctcctaccttttggctgtagtgattaatgctgctgtgaacatggatgtacaaatttttcttcaagtccctgcttttagtttttgggggtatatgcccagacatgaaattgctggatcctattgtaattctctgtttaatttttttgaggagctgccatactattttccacaacgtcgcaccattttacatgcccatgaacaatatatgagggttccaggttctccacatcctcactgacacttgctattttctcttttctggcttttgataatagccatcctaataatgggtgtaaggtgacacctcactgtggttttgatttgcattgccctgttgattagtgacgttgagcatcgttttttattttttgttttttgtttttttgagacagagtcttgttctgtcgcccaggctggagtgcaatggcggcaccatcttggctcactgcaacctctgcctcccgggttcaagtgattctcctgcctcagcctcccgagtagttgggattacacgcatgtgccaccacgcccagctaatttttgtatttttagtagagacggggtttcaccatgttggccagtctggtcttgaactcctgacttcaagtgtttcacctgcctcggcctcccaaagtactgagattacatgcgtgatccaccacgcccagcctgttgaacatcttttcatgtgctttttagccatctttaaagtagatcttctttggagaaatgtctattcagtcagagctattctcaatgtacattttaacccaagcgtatatcacatggtgaatttaggtgagtaggcaggggacgggggttgcctatgggatctgactcatttgcgcggctagctctgggtactccaacccatagagacagctaagctgtcaccaaaattcttatctgactcatagtatttacaaactttaaaataattggtatataatttgagacaaaggagattttgttttgacaagaggctggtttgcaaagaattgtgtgattattgtttcagcagtacagctccgttggggtgagacatgtttcttctttgacctcctacatcctcctctagcaaacgaggagaggaataggctctaaggcttcttgcttttgctagtcatacaaggggacttgtggaattggcagctctgctatttggatttcggcactacaaaggatactcgtatagtttgctgggtctgctgtaacagatgaccacaaactgggtgacttagaaaagcagaaatgtgtctctcacagttctggaggccacaagtccaaaatcaaggtgttgacaaggttgtgttccctctgaaggatccaggggagactcgttcttcattgtttccaccttctagtggctccaggtgttcctttgcttgtagccacatcactctaacctctgcctccatcttcacatggcctcctcctcttctccctgcctttcccctctgtatgtctcttataagaccacttgtcattggatttagggcctaccaggcctccaaggacctctattggcccattcttttcctacttttcatgcaaaacttaaggctacgggagcagttaaagttactttttggttcaagaagaactgaatgaagcatttggtgttagtcattatgctattcattgaatgaggccaaagaggaaatgattctttccacccaagtttgcttgcgagtcccagtctttctttacactcctgccccatgctgtcgctgtacacctactttacaaagcatgtccttggttgtttatttgttagccagcatctagttgttgcgacaaccccaggagttagcctttaggcaggacctgggagccgtttccaggacagataggacagcccctgcctgcccaagcttataccgcatggcagcagattagataggggagaactaaagtggtggagagagtccaaaggcagcccaagaggaggcataggcagggagactcctgcacaggaagctgtgttacaatgataataaaattagctgccttgaatggcgtgttgacaggtatttgacacaatcctcataatgaccttatgaggccatttactttacatatgaggaaaggcaagctcagttcttttaaataactcccccgagggctacctgctggtaaggaatagtagctgggatttgaacccaggcagccgactctgggttaatttattgccagctgcactgaggagtggcgtgatttgtgatttctcatgtgtagagggtgagcagaggcttacaagagcagaactccacaggggtgggcttgcttagcccggctggcctagttagcctgtcatgcggtcctgtcactgccccaggcacacgcccctcagatcccctgccagcagaggtcaataaggccttggtggggtcagaggccagatgtgagccatctccttgcccctgtagatgccatgtgccttttcatttgctcacatttccctgaatatctggggaatctggataagaagccagcagtgggcattcgtgattatatcatcactaaataacagtcacttgccccactgaagcccctgcaccttagatgggatatgcatgtatgcgatggagagcagtatgggagctctggtgggtgtgcccacacatggtagtctcatgacccccggccgatatgtgagtgcccactttgtgctgggcactatgcttcatgcccaagttgcaacagtgggcaaggctttggtgcaaggtgccaaaatccttgttctctagctgctttggtctagatacacattgagtcccagtgagttcaatatcagccacatgtctttcgaatgaacagttgacagggcccctaccaatgtgaaggggattctgggataaagggagggacagggcaggcacagagctacagattgacttcaatgcattctaaaaatggccatgacaagtcaagttttgacatacagtttcttaataacttccattatgagttcagaaaaatgttcccccaaatggctcctccagacattgagggtcctgcatccatttcaaggccattttggctttctacatgcccgtaaagtctgtccccactgggacacatgatcatgcccattcgttaaaagtggcaaggagtgtaaaattcgaggtgtggggttggattggagcaatcacagcaggtggaatcccagtgctgcctgccacctcctcactgaagtgttctgtgaatctagcctttcatgagcaaagttagactcttgtcttgtcgtgggttttgccatctccagatgttaggggagccatgactaagtaaattggcaactaccaagaaaacatggatgcaagaccaaatacatcatagtcaagtggcatctttgtgtttgcagttcagtatcatgggtgactgaggagaggagcaccctaagggctgtcactaaagccatactcctctgtttggcaacgttgtcggattttattgctaccgtctccctgctgtgaactgctgggtgcccactgtactctgatcacttctcaagggtttctgatggcccaagatgctaagttcctccacgcatcgtcagggcggctttaacttagccaagcaggagagctccgtctcctattgcactccactcatcccccgtcccagcatcccatgtcctgagctcctagacatgagcccttgtgcccatttcattgatgggaaaactgagctgcagcaaagggaagtgactggagcaattccgtacagttcgtgataggcccagagcaggactccctaggtgtgggcactgctacaccctaatgagcaccacaggggaaatccacgctgactgaagcgtgggagagccatggaaaaagctacaatgccaaagacgttttttatgttgtcactgataagtgagctgatttaactggcctcctgtgcgcctctaatctaacagtgtggtgagtcataggcccagtcgttggccccgttagccgggcatggtggcagacacctgtaatcccagctactcaggagcctagtgtcttgtcgaacagctgtcgctatggttcagctatttgtaaaaacatgaacggggggatggcatctgcccaaaacactaacaactaaagatgttttgacttaggcaacattaatgtctgtctctaactatgtctttaagaaaagaaaagttgattacaaacgggaccatattttgcttcgaaatggaaccagcagttagcgagccaatgagagaccaagtcgcacggactcatttgacagaggacactcccaaagtgaatgctgacatagaaaaggttaaccagaatcaggtaaggagaaagttgacacgtacataccaacaggctgatactatttacctgtgggtgaaaaattgtatttgtacatgtattaatcaatgttgggtattttttatgtaagatatatagctttgtttaagatgtgtcagttacttattgctgtgtaacaatatcagaacacagtggtttaaaagaacaaccatttctttgcttatgactgtggtttcggctgagcccagctggggtgttcttggatggtctcccctgggctcttgcatgtagttgcaatcacatggggaccccttgaagcatatgctcccaggtggccttgctcacacctctggtagtaactggtggctgtcaactgggcaccttggtttgccttcatgtggcctccagtagaccaggctgggcttcctagtgaaatggcagcagtatttattaggcctaagatttagtgtcgcaagtctcagtctgagagaggacttgaagaaattgttgagcctggtcgttgtcaggcttcctggagattcttcacatcagtctgcaaaggtttgctttgattgattcttaatcagtgctgcacttcaaaaatgtggctgggcacggtgtctcacacctgtgaaatcccagcactttgggaggccgagacaggtggatcaccagaagtcaggagtttgagaccagccaggccaacatggtgaaaccccatctctactgaaaatacaaaaaattagccaggcatggtggcagacacctgtaatcccagctactcaggaggctgaggcaggagaatcacttgaacccaggaggtggaggttgcagtgagctgagatcacaccattgcactccagcctgggcgacagagcgagactctgtctcaaaacaaacaaacaaaacaaaacaaaacaaacaacgtaattacatcaagacaaaatgtgtttatatcaaatgttaataggttcaagatccctaagaggttatcatgggccgtgaaatcaccctgtatttggtgtagaactcagagtcaagcctcctctgggcctctgtggttgaagccacgtgccatctgcagttcctcatttatgtaaatttgggttttatggctacttggcagccagcaaacaaaggtggattccaatggttatagcaaactgccattttcagctagtttcaaatttttgtgtccttcgaaataacatttttttctctcattagtggactgattttataagaagtaaaagttctaaatttagactactaaaacaaaaagaacacatttgtcttaacttactatacgttctgcataagacctctctgagaaaagggtcccactgctgacaacaaagcaaaacaagaagggttggaaaaacccagcgccctagactattctgttatctcaagattctattgcaattagattagtttgcctaaatggttttttttctttttttttttttgagatggagtctggctctgtcgcccaggctggagtgcagtggcgtgatttcaggtcactgcaacctctgcctcccggattcaagcaattctccctcctcagcctcctgagtagctgggactacaggcgcctaccaccacacctggctaattttttgtatttttagtagagacgggatttcaccatgttggccaggctggtctcgaacccctgacctcaggtgatctacccaccttggcctcccaaaatgctgggattacaggcatgagccaccgtgcctggcccctattcttaacactgtctccaagaggttgatcttataactcacctcagtaacccattatggagtcttgctgtttccagtcttgagttttatacttgattgttagtacatgttcattcttgtccactgtggctgtgagaagtaaaaagtggtcatgaaaagtttcatgtgatctcctgtaatcacacagcattataggtatgattatcacacatttgacttccctggggtaaaggccagtttgattcccatcactacaagggtctccagggaacagccattggcctactcatcccaaacattattgatagaacatttcaatatcataaaataatccacgtcacattgtccaagagtagcgtactgattagtcacaattaaaatcgtgaaatgaaatcacactggactaacagcaaggttgttttttgaagagattagcaaccttttgaaacacctgtaactagagatgccaaatgaaataaacaaggcagtctgaaatctttcaggatgctttagtaacatatctagttctgactgtctttgggcttagccagacttttagtaaactgcagaaatccaggttgggaaacaggcagctcagagttattctaaatagctacagtttgcctgtacagctgacttgggaggaggggagaagaaagggattgctagaaaagggattgatgtgagttttgtatttaatttggctatgacttgaggaaatatacatctcagtccaggtgcaaatcatgtaacctggtatgattacatgtgtttaggaataatcagaataaagcctagaaaagaacaggttgggaagttagttttgggtggtagaagaatggtgaggctgattttgttagtagattgcacatggacagatgaaggtaaagtacagtgccagctccagctgggcctggtggaatccagtatgagtgctgtttcagatgggacaccccaactgggagggaggtggatctagagaggatgtctggccctggcatcccttgagtctcttgcatagctcaattgtgttgatgtttaaggaataagtagggagatttgtttgttttttaaatctagaacataatttctttaagatctttcatttccacaaacccaagttggatttactgtatatgagctaaggaaattggaggttgtcatcttaaggaggcccagatacagttttagaaagaccctagggaggagggatatcacaggtcctcctcacagacacccatagccagcttgtctggtgtgcagcagccacagtttggcatcaacatcctgaaatgagggtatttaagtgcctgcatgtgctactgtgtcctttcattatgcccagtcaccagagttggaattacccaaggaatcgtgtgtgttgtggaggctgagacataaacaccatggctctccccatttcttcaacttccttgtagttcggaggagggaaagcagagccctgggctcatccatcctcactgcagccccaccaggagatcccatcaaggcggtcttagatttctaggctgaggcaagaaggggttgggcgatgagcccagagccacacagcccagccctgttgtggccagagagggaaagggactgactttgtcctgcaagtatggagactgctttcttctttctgttgttttcagtgcaagctatcagctaccaaatggctgccgttttgttttgttttgttttgtccttagagaagcgcccagggatcagctatcgggaacaagaaggtatcactgttttttggggtattttttagattgtccagttttggtcataggtggtttgatttcctttcactgaatacaaagcatggatcttgtcatcaaacccaaccaaagtcaatctcagtgtcattcgctatctctcttccctccttactgatcccaggagagaaggttagggttgcactagtgatggaacaccaggatgatataaagcttccaacttggctcaagaagagttccaaacaaacaagtatatctgccattgcagtggctcatgatatgtaagtctggactctgtagcttccagtcctcactaccctggtcttccccaccgttcctctctttccacaggccaagagatgcacagtgatcggtggctctggattcctggggcagcacatggtggagcagttgctggcaagaggatatgctgtcaatgtatttgatatccagcaagggtttgataatccccaggtgcggttctttctgggtgacctctgcagccgacaggtaatggaccatgcagccttgctgatttcccacgagcccacgaagggaaaccacgatacttcccttgctcagaagccagccaatttgtttgaaaaacaattgtttcattgtgaaaattttcaaagttataggaaagaacaccacattcttactgcttagaatgaataaccatcatctctgtcacagatactcagctgtgtcctggtagcacaaaagcagccatggtcagcacttaaatgaacaaatggctgtggctgtatgccagtgaaacttgacttcaaaagccgtccatgggctgtattgttccaactgcaaaacaagtgtgtgctgggccacagggtcttgattttttaattgagatataattcatgtaccacaaatttcacatttttaaagtgtgcaattcagtgattttcagtacatccacaaagctgtgcaactgtctcccatgatctaactccagaatatttgtattaccccaaaatgaaatcttgtagccatcccctctcttcccctcccagcccctggccgccactcatctacttcccatctatggattggcctcttctggacatttcatataaatggaatcatgtaatatttgtacctctgtgcctgacttttttcacttagcatgatgttttcaagcttcatccatgttgtacaggtatgaatatcttgaattttattagatggtgccaaatggctcagcaaagctgctatgtcaattttacctccatatccacaatgtggcacaagccccattgcttcacatctttgccaacactgggcataactagactttttggtgttgccattctgagaagtatgaagtggtgcttcactgatgttcagagtcacatgtcctccctgaccaagtaaccagccactctgccactgggtgatcggctttcaggcttcctcctgtgtgaaatgtttgtctgtgtcctttgcccctttgtctttggggttacctttgcttccttgttgatctagttgggatgccaatcctgtgcccgttgtacttattatggatggcttccctcagcctgtcactgggcccttattcttggctttggtgtcattcgctatatggtttgttgatgaaatattaaggccattgcttccgctgcaaagttacggttgttttctctcccgtgctgcccacacctccaggcctggagatggggtagacatctttcatgctcatcattgctgcctccgaaccgttctccctcatgctgctctaagcctctccagctttgaagaggataccctcagactgtacaaaccccgacaccgttccctccttgtggtggccacccacagccgcctgctccccttcccagtgactccacatcatttctcagtgatttcagctcctttctggcattattattggtgaattcagcgttcatgtagatgaccctaccaatgccctcgcctctctcatccttggcctcctctcacccaatgatgttgccctccactcccctgtcatcaccagtaagcacgtcctctccttcttctcagttgcaggcattctactctgagcactagctcctctctgtccagctcatgccctctagtgcctcagctgtcccgattccttaaccccacccagacatccagccatgcccaccatggctcagcctgttcgtgcctcactgcctttagttccctggtctgcttgttcgcttgcatagtcttcaccccttcccctttctcttctggttgtatgtatccataaagtttctccagagaaacaccagcagggggatgtgtggagaagggcaaggagagagatgggtgggtgagacggagaaagagaggttgagatttaattcacagaattggtttacatgattgtgggggctgactaggcaagtctgaaatttgtagggcagaccagaaactcaggcaggaattgatgctgtggtcccacgttagaatttcttcttacagaaacctcagtttcacttttaaggtctttgaactgagtatatactgcctgtccagagtagcaagggtaatctccttacttaaagtcagctggttgtagatgtcaaccacagctacaaaatacctctacagcaacacctacactgtttaatggagtcaccggggactagagcctggcccaggtggcaaataaatgtggccaccacagtgtacttcacattgtaacccccaccctggttaaatcttgccttgtgcatggccatggccctcaagcagacccttggtaccaccaagcaccatctccacaaacctgcccacatccacgtctctactcagcctcccctgctgttcccgaggacgcctcatccccaccaaagtgcccatcctggtgccagctggaagccacctcctcttccctacccagtcactgccaccagggaccttgaggcaaccatatctggtggttgaatctcagtcctcctctgacttggccctgtagcagcatctgatgctttctttgcttgccttctgagataccacctcactcatttctcctcctgcctcactgattgtctcctgatcactatcatttctaaactttgcagactccagaacttattctcttttcttctccaagtttagacagtgtcacagtgactccatcccatctcatggattaattactgtctagaagctgatgtgctccctgcttgttatctccaacccctagctctctcaggcacgtgtgtgtgtgtgtgtgtgtgtgtgagcgtatgtgtgtgtatgcctgctggacatccctgtttggatacctcatggacacttcaagcttgctacatccaaaattaagctcctggttccctgacgcaagcccctcccccaccacagcaaacctatttctgctaagtcttctctatctccataaatggcctactctgcttttccagttccatcaaccaaaaaccttagattcatccctgcccgattcctttctctctcatgcccttcatcccatccatcaggaaatcttgttggctccactcagaatagatccccaatccaacaacttctcaccccttccattgctgccaccctggtccaagccaccatcactgtctcacctagatgttagagggactcttaatggataaatcagatcacaccgccctctgtacagaagcctccagtggcgtccagtcccatgtcaagcaaacagaggcctctgtaatcacccatgaggccctgcacggcacgtccccactacctgtctggcccacttcctcccacacccgcctcatggctctgccccaggcacactggccaccaaccaagtttctgcctcaggacctttgcacttggtgtcctttctgtcaggaatgctcttcctgaaccacagaacttgctccctagcttcctgtaaatctccagccaccctgtgctaaggaacaggcccccgctggtctcccttactctgctctagtttctgcataacacctgccagtacggacgtcctctagatttacttgtttgtttgcttatttgtcctgattgaaacatgattgaccatgagcggatacagagcagaggaaatctctgaaatttgtcctctctaccatagaatgtaaactccacaaaagcaggaattttgtttttcgatcactgctttgtcccctcaaaggagacgagaatccttagcaagctttcacttctctccaaaaggctcccccgctgccatgctgttgttgctagtatgttatttcagctttccttgagtacagatttcaagggaaccctccagcatgccatgttgttctccagccacactcaactgctcagccgcaagcgtggagaaggggcgagttgcatttaaccagggttggagtttactagacaaatttaataaagggagaggggaacaaggcaaaggtggtgctggtggatcatgaaatctaagctaagtccaaggtcgatgtgatgtgggtgaaagacatggcaggagaggaccttttttattttattttattttattttatttttatttttatttttttagacatagtcttgctctgttgcccagactgtggcacaatctaagctcactgcagcctccgcctcccaggttcaagcgatgctcctgcctcagcctccctaatagctgggattataggtgcccaccgccacacccggctaatttttgtatttttagtagagatagggtttcaccatgttggccaggctggtcttgaactccttgtatcaggtgatccgcccgcctctgcctcccaaagtgctgggattacaggtgtgagccactgcgcccagccgagaaggacttttaaaatgtactttcacctgggtgtggtggtatgcacttgtagtcccccagctatttggaaggccaaggtgggaggatcacttgaggccaggagttcaagactaacctggactacataacaagaccccccccatttctttttttttaaaaatgtgtttttatagtcagtagagagagagagagagagaggagagagacagatatacatacatatagataaagtttatgtatatatagttatatagttttatacacacaatatgtattacataacacttttttttttttttttgagacggagtcttgcgctgtcgcccaggctgtagtgcagtggcgtgatcttgactcactgcaaactctacctcctgggttcaagcaattctcctgcctcagcctcccgagtagctgggattacaggcgcccaccaccacccatgactaatttttatattcttagtagagacagggtttcaccatgttggccaggctagtcttgaactcctgacctcaagtgatccacccgcctcggcctcccaaagtgctcggattacaggcatgagccaccgttgccaccgcgcccggcccatgacacttttaaagtcacctcggtcttgtgcatcttttgttgctgacaggaagtctactctcaagccggtcgttgttcgtttgtaggttgtctggctttccctcttatggtttttaggattttattttttatcatttatagtctatagagaatatatctgggcctgagttttagttttgattttaaatcttaacacctggtaggcctgtgcaatctgaagatgaatgtctttcctcatttctggaaaattcttcaaagattaactctaccccttttctctcttttctctctttctagaagccgtgctggacatatggtggtctttcattgtatcatctgtctcttatcctctctttcttgcattccttctctttctctttttgtactatttcataggagatttcctcctccctgcctctgctcatggccaatcgtgtttcacctatattcctcctcagattatgttgaagtcaatcctagacatcatatcattttatctgcaaatatttcagtatttgtctctaaaagataaggattatttttaaaaacattgacagtagttccttagtatctagccagcgttcagatatccctgaatgtcttataaatgtttttgtattattgtttttccaaataaggaaccaagcaagatcaagactatggatttggttgaaatatttagctctcttttaatttacgattcccttcatttttttaaacttcagtctatttattgaataactgatgtttagtagaaaccatgtttatggtgctgtagtatttcccacagtctgggttttgccgattacatccccattgcgtttaacatgcccttctgtcctccagtattttctgtatactggtagatctgggatggcgctgtccattaaggcagccattagccacgtgcaactattgggcacttaaaatgtggcaagtcagaattgagaagcactgtaagtgtgaagtccacaccagatttcaaaaactacctacagaaaaaaggaatgtaactgtctcattaaagttaatttcacctttttctttttactttttaatgtcattactataaactttaaagtcactgtgacttttattatgtttctactggactaaagacttgatcggactctggttcagtttttccctctggggtattattacttctgatactccaatagtaataagcatgcctagtgctcagatttgggtttctatataccatttcccataaaaagaactagggcttcttgggaaaattgctcattctaggaccctagggcaagggcagtacaaaatgagtctgggacattttcttagcacaaaatgaatggggacctgccaagaagatacaagagccaacttgaagggcttcccctggccaaatttgggacattttgagcattttgagcctctcaaaacataacagtagtggatgacaatgcattttgatttcaaaaagaatccgtgggctgggtgcagggctagcgcctgcaatgccagcactttgggaggccaagacaggtggatcacctgaggtcagaagttcgagaccagccttgccaacatggtgaaaccccatctctactaaaatacaaaaaaattagccgggcatggtggcatacgcctgtaatcccagctactcgggagaatcgcttgagcccgggaggcagaggttgcagtgagctgagatcatgccactgcactccagccttgccgacagagcgagacaatgtctcaaaaaaataaaataaaaaagaatccatgggtccatagaaatactgaaaataacaattggggtcagggagaaggggaagctctacagaggaatgccaactaataaatgtaaaggccatgaattaaaaggctagacttagaatgtcaccattttatacccagtacattgattattgttccaggcaaggactatcaataaatgctgaggttaattggtagaattaacatgctacagattacttatcaattgcaaaggaaaaggtacctttttgatggccggaatctggcagccatcatcatcaccacgtgctccaacttaatatcaccaaaagtgggacagacttgcacctcctgaggtaattccctgagaaggacacaccaccactgatgtggtattcttgccaaaaccattaagcctgaatctaatcttgaggaaacagactaatccaaactgaaggacagtctataaaataacccaaacccttgaaaaatggcagcattaaaataagacagaaaagacgggaatttgtctcagattaaaagagatggaagagacctgaggactaaatactacatgtcatgcgcaattggatcctggaccccaaaacaaaaggctataaaagacattactgggacaattgggggaatttgaatatagactaattattggataagaacatcatatctgttaagtttcttgagtgtgatcattgttttatggttatttaggagaatgcttttgttcttaggagatacctgtgaagcgtttagaggcagcatgatgtctgcaacttacttgactggtttcaaaaaaaaaatcatgtgattgtatgtagagagaggaaattgtggcaaaatattaattggcacataattgtcataattgtcttttggtgacaaacatgaatcatacttagatcatattacttaattaaggtttgacaaaatgatgacatgctattagtcttcatttagtagctccagtctttataccttaatgcagaataaatatttgattctttccctttatttacctgaatttttattcttgcttgtggtcaagctgtcccttctttgcccagtgggaacctcttcaggttggcccttgagtgcttttaacgtgaccccggtagtcttagctagctagcatcctcactctctggtacaaggtgtgcctggttcctcttgtgtgtttcctgtcccagatctgcaatcagccatttctctcaggagctcttgttccttttagcagtaaatcaaacagacctgttttaaaaatccctttcaggttgctgtattgtgtcaagtttcacaggaaggaatatgcctgtgtattggctatttactgtctttaatggtgtggaactttttcatgtgattcataatttctatctgagttcaccttcctggggagttttacctcctaggtgcctgctctgaaccacccaaaaggatgttgcctctgtgtggatcccacaggcttctcatgccccaaaccccttttgactggggactagttagtggggagaaggtgattaaagggacaacttggtttccatcccatgtacttcggtatcattgattcttttatgagaatgtatttccatattgattatagaattataagacaaggaacctacaagccacaggttggagggtgaaaacatgagaatgccattgacctgtcaaagcaggaatgattattttgtctttctttgcttttccaggatctgtacccagctctgaaaggtgtaaacacagttttccactgtgcgtcacccccaccatccagtaacaacaaggagctcttttatagagtgaattacattggcaccaagaatgtcattgaaacttgcaaagaggctggggttcaggtaaggggaaggctggagtgagtgctgtcaggagcacgtgatggccctttctaagggtgcaaggccgtagttcttgcagtctccctgggcctaggcggggttgcttcttaaagtgttgggaagatcttagaaatgaagcccttggagtcactggagatggtgaaggtctgcttgccaaggctgatttgagatgtaatattctaactgcacacaaatagaacatctgaggacctcaagcctattggccttcagttaaagagctgcagaacttagacattgcttatatttttattgtgataaaatatatatcacatacaatttaccatcctaaccatttttaagtgcggagttcagtggcattaagtacactcacaatgttgtatagccattaccaccatccatctctaaacctttttcttcttccctaataaaaactctatacccattaaacagcaactcctcaatcgcccttccctacccagcccctggcaactacccttctactttctgtctctatgggtttgacaactatagggacctcacagaagtggactcatgtagtatttctccttttgtgtctggcttttcaccgagcatgatgtcctcaggggtcatccatgttgtagcatgtgtcggaatgtccttcctttttcaggcagaacaatatttcattgtatggatgggccacattttgtttattcattcagccatggatggacatctgtgttgtcttcaccttttggcaattgtaaacaatagtgttatgaacacaagtgtacaaatatctgttcaagtccctgttttcaattctttcaggcatctacccagaagtagggttgctagatcatatactagttctacgtttaaccttttgaggagccaccacattgttttccagaccttgcttatattttaaaagaaaagcaaactgtgtttacccttagccaatagaaacgtgttataactcaggcctgaggggatacgaattttctgcccatcatagcttgctgcatcgttaccaatcctggttcttagaattgtctttagaggactccagccactggctaaaacggctccctgtcagctcagtatcctgaccctcacagggatgcatgccacaggtactgcataaattaagagaaaaacttgaagcaagccagggggttcctctcccaacaacctgtcctggcactgttggctggtccgcagcatcctcagccggcccagcagggttggagctcttctgggcttgggccctggaaaagatcacttataactgacccctagcagttgacaagatgctttgccctgctgaagttttcacctaattagctcctcgttgggtgaccaggggctaaacgatgtctctttgctagtaaatgggagaggtggggtcaaagcagattctccaagtcccagactctgcactcagccatgctgatgtaactggagccctgggaagggccctgctgctctttgttaaatggaaggttgggggcatacaacaaagatttgtgccccaggtgtggcggctcacacatgtaatcccagcgctttgggaggccaaggcaggaagatcccttgagccaaggagttcaagaccagcctgagcaacatagcaataccccacctctacacgaatttttaaaagccaggtgtggtggtatgcacctgtagcctcaactgtttcgggacgctgaggcaggaggatcgcttgagcccaggattttcaggctgcagtgagctgtgatcccaacactacaccccagcctaggcaacagagcaagaccttgtctcttaaaaaaaaaattaaaaaaacaacaagatttgagaataaaacagcacctctccactcaccacagcatttaagaaacaacattactggcatgtgtaatgtgtgcccatcctcgatgccattgctctcttcttgtagccatggatagcaattctgaatttgggtttatttccatttgctccatgtgtaagcaatataaagtattggattgcatgttataagattttatacaatgatatcttattgaacagatcctcctgcaacttgcttttttccccagtgttatgtttttctttattcatcttggcatatgtaactctggtttatttactgaaggggcagagtggcttagtgggtaagagtgcagaaagtgattgctgtgttgtattgaaggaacattttccaacactgagatcaaaagattatttaatgtactttttttcctcaaaggttttaagtgttgctttccacatttcagtctttaatccaccaggaatttatgtttgcttatggtgtgagatagagatctaactttcttccatgtgtataaccagttcagtgccatttattgcataatccatcctttctgcatcgctgcacaccatctgcagcatgtcttaggtgtttgtgtcttacatgggcctgttcccaggctctcccctctgccccattgacctccctgtctgcccatgcagagaagctctgcctttttaggataagtctcagtgtaccgtagataaatcacgcccccaaccaatttcttcaaacttcacttggctattctgagccctttgttcttctacatatgtttggcttaaccagttccttgctaaagccagctgagactgctgttgtaattgtgttgaacttgtaggtaattttggagagaattgacatctttcccatattgagtgttcctgtccataaatatgggatatgtttctgtttatctcgctctttaatgtcatcaatagagttttatactttacttcgtaaagattttgcatatctcgttaaatttatttgtatgtacttcgttttttgttatttaataactttctattacattttcagttattgctaatatataagacgagttaatttttgtatattgatttttaattcagcaactttgccaaacgctaatattttctacatatttgcctgtgttttctgtgtagatttttctctcatctgtaagcgatggaagttcagtttcttttcaaatcattataaattcgtgtttatcttaccctaccactctggctagagcttctcatacaatgttgaataagaatgggaacgatatgattcatgctaatggtgttcagtgttggatgagcttctcttaaccagcaggctggacgctggggaccctcataagagaatatcttcctttagaatagcatttcttaagaggtcgtgtggtgtgtgtattcctatgtgtgttcacatggccaggtcactatcagaatagccagtgatctttttcagacatcttcctagaagtttgcgggctgcccttcacttacaacagagaatcgctgtcatagtgagataccatgaatgcaagtctattctatctctcaggtgtgatgggatagaaaaaatgtgttatcccttgttttgaaaccaagatctcttgattcttggttagaatgtaatacatagtgtgtctggaatccacatagctgcaaaagatggtgatctttggattattttaagaaggcatgaaaagcaaaggcattgcagcaaataatttcttcagtgcctcgaatgcgagggcaacaaagggatgcccctgattctctttcatacaggatcatgcactgtttgaattgtgataatttgtgacttttattttttctgaccttcctctgtcagaaactcattttaaccagcagtgccagtgtcatctttgagggcgtcgatatcaagaatggaactgaagaccttccctatgccatgaaacccattgactactacacagagactaagatcttacaggagagggtatgtaccttggaactggttgagtgagcagactgaagggtttagaatcctaagaaaaatgtttatgaacttatgaagtttgtattctgaggcctacgtacctgatttgagatgtaaaatttgtgggtgaaattaaatttaaaaatactgtgagaggccgggcacggtggctcacgcttataatcccagcactttgggaggccgaggtgggtggatcacctgaggtcaggagttcgagaccagcctggccaacatggcgaaaccccatctctactaaaaatacaaaaattagcccagcatggtggcaggcgcctgtaatcctagccacttgggaggctgaggtatgagaattgcttgaacctgggaggcggaggttgcagtgagccgagattgtgccattgcactccagcctgggggatagagagagagagacgctgtctcccaaaaaaaaaaaagttactatgagaacagctttatgtggccagacactgttctgagtgttttccaggagtattttccttgtttaaaggtcacaattatcgcatcatcaccagattatagatgaagactgtggtgcacagatgcacagagaggctcagaacctttctaaaactgtgcagctaggaggtggctgaccccaggcagtctgtctacagagcttacagcccaccctcaatgccatgggagcttcctcgcctgctatgggaatttacagcagttgcaagcgtgcagacaggaatcaggctggaggcaccttcctagtggcactctcaccccctcccttacttagaaaaacaaacaacggaaggatcttgctttattttaaggaaaaagtacttttccacttggcaaaacagcttcatcaaagggcacctgattttagtatggttggattcagccacggtcgctaccaagccttcaggctgctggggctgtggggcccctgacaactgctagctgcagatggggattgtcaccctgaggccatcctaagctgcaggccaggagtgctcctgagcctgggatagctcgtcttagctgggtagctgtgagtatacccctcccaggtgtgtgcagtgtatcacacccactgaggttttctcgcaaagccggtacatgctgtactggagctgaacactgacctggctacctgagagccagctgcctcctggctgtttgccgtattttttttttttttcttttttgagatggattctcactctgttgcccaggctggagtgcagtggcacgatctcggctcactgcaacctccacctcccaggttcaagcgattctcctgcctcagcctcctgagtagctgggattacaggcgcgtgccaccatgcccggctaatttttgtatttttagtagagacggggtttcaccgtgttggtcggatggtctcgaactcctgacctcatgatctgcccgccttggcctctcaaagtgctgggattacaggcgtgagccaccatgcccagcctgtctgctgttgcttcagctcagaaagtcctggcagaactggtccacagggagacacaagggccacccagaccaggggtggaggcttgaactttggcaagccacagtcctggctccagactatgctgtcttgctccttggagcactcatgtgctcgaacttggcccaaggagtactaaagcctccctgcgccttgcaggcagttcagtcaccatggagaccctgtgtattctcaacccaatatgcctgatactgattgccaccagagctgagcccatctaggctcaggagcttcaaatgatggccttggcccagaccatcagtgtctcgcttatatcaacttttgggttctcaactggaaataagcaaagcctgcagatgactccagcagtaactcaccggaagcctcctttcagccgaggttgacatccactgttggctttataaccttcctactgatcataaaccaaatgtgatggggagctaggactccttcacctctcttccctttagtagtagagatgagccttggtggaagccatttgagggtttatttagtcatttcctccatcgctgtggggaccagagtcctggcgggaagaggagggccagctctgggaatctgttgagaggcagcttttccattgttgagttgcttaagatcactggggccaaaacatagaccagcactttgctaccatagagtagaagaaacccgaggtgacatgacagcaggaaccgtacttaccaagcatacagacacgcactgaagcaactcacatgggccatctcatgtaattcgcatgcagccccgtcagggtaggtacctttatgatcaccacttttacccacgataaaacaaatcctttggaaagttttgttacttttgaggcgaaacccatttcactgtgctttagactcttgagttctagtttgtccatgaagtcacacagaagtcaccctttccttgcggtggcaacaggagcactggctctggaccaggcactgctctgaggactttacatgtctcggcctcctttgccccccagctgctggcctgtttctccccaggcatggtcttcagacccttcaccttctctgaccctcttctgggcccacttgggtttctcagagccctcccctcggaggtgatactcagaattgcctggaacagacccggcctggtggaaacgtgggcggcacatgcagttcaagtcactggaggctcacggctaacttgtttgccagaacctttggacgttttccacaaactgctgccgaggcatgtcttctggcagtgttggtggattttagcctttgaacgcaaaccagggccttctgatttgatcttaccagtttttgcccagctgtctgtcctgcattttcagattttggtgtgagggtgggtggggtagagaggtagcccagaattataccagccactgatgtaggttgtcagctcaaggcagaccactgctcagtggccacatgccagcagagtgtgtcatctgtctgtcccccacgagtggtgcttctcacccagcgaggcactctcttggcttgggcctaggaatttgcaatggacgtgccccttctcccactctcctccaggcagttctgggcgccaacgatcctgagaagaatttcttaaccacagccatccgccctcatggcattttcggcccaagggacccgcagttggtacccatcctcatcgaggcagccaggaacggcaagatgaagttcgtgattgggtgagtcagcccacagcggctcttccctagtccttcctggtccatgctcgcattcagagagcacttggcaggagccacatggcattgtagctcttttcttatgtgactgtcttggtccatgcaggctgctgtaacaaaatacctaagactgggtaacaaacaacagagagcttggaggctgggaagtccagatcaaggcgttcccagactgggtgtccattgaggccctgttcctcatgagtggcaccttttcaccatgtcctcacatggtggaaggggcaaacaggctcccttgggcctcttttatgaggacactaatcccattcccgagggcagagcccccatgacctaatcaccccctaaaggtccctcttcacagtaccattgcactggaggttaagtttcaacatatgaatgttgcggggatgcaaagattcaggcgatagcagtgaccttgtccgctgtcctctgtattcatttcttgtagttgccataacaacctgccacaaagtaagtgcttaaaacaacaaatggattctgtcacattttgggaggccagaagtcctcagttaagatgttggcagggctagtgtcttctggaggttcgcagggagcgtctgttccaggcctctgccctagcttctgctggcttccagccatccttagcattctgtgcttggagaggcatcactcctgcctctgcgtccctttcacatggctgtgttccttgctttctgtgtccaaatttccctcttataaggacatcattccctggatttaaagcccaccctaccccagtatgagctcagcttaactaattgcatctgccgagcccctatttccaaataaggtcacattcacaaggcccaagtggacagaagctttgggaggatactgttcaatccagtgtaccctctcaggtaggctgggaaggtatttgtgaccctgtttggaaattgaagaaaccgtgactcagagggaaagcaatgggccccgggtcaaaggccagggcttgactgtccttgcatctgggaaggcaggcgggggcattacttttctcctcgggttaagtgcaggtggaggggcctccacaggggacaacagtgtgcctctctcccaaataggctttctcttccttcatttcctccttttctcctctctctcttccttcctttttccctctgccttgccttcctgtttctcactcagcctcactgctaccctgacttgtcaccttgaaggattacagggagactggtcaataaacggaggaccagagcaaggcgttggccccgtgtctcctgggaaggggctgaaaagctgctacccaaatcgggacaggagagacagcaccagtgttggccatgctggaatgggtgggcaggtcccccagctttcagattccactaaccctgaagacccaggagtcccggcccagtgtacatctttaaccagtacaggcatccatgagtgcctgggccggccttgccaagtgaggtggcagccattctgtaggtcacagtctctcaaatgccaagacttgggagtggccctggccttcgtgcaggggctcccagcacgtattccatcatcccttgtgcacctgcagaaatgggaagaacttggtggacttcacctttgtggagaacgtggtccatggacacatcctggcggcagagcagctctcccgagactcgacactgggtgggaaggtaaggcctgctgcaccggtccctgcacaggtgcctttctgcgggtttcttctccttgccattggatttgctggcaagttgctcctgtgatcctgtatcatggaggatctgccttaggaccccctgtgccaagatcaagcccctctgatagagcatgtggtgtcactgcagcgtcacatcacttgggcagccaaatttggagagctgacgagctgggattgaacagacattcaggtcacggtcatctatggtcccctgacctggctgcccacctgttggcatggctccttgtggcaggagcccacgtagattgggcagggtgcttgctcctcaccctttctcccactcattcctcaggtctctccctcccttgctgtttggtcctcttttattctcctgaacctctgccgtttccccactgataaccttcaaataagttgggaatagggtgggtgtggcattttttttttctttttttttttttgagacagtctcactctgtcaccctggctggagtgcagtggcgtgatctcggttcactgcaacctccgtctcactggttcaagcgattctcatgcctgagcctcccgagtagctgggactacaggcacatgccaccacgctcagctaattttttgtacttttagtagagacggggtttcaccatgttggccaggctggtctcctgacctcaggtgatctgcccgcctctgcgtcccaaagtgctggggtgacaggcgtgagccaccgcgcctggcccgggtgtggcttttgatttaaaacaagcagaacaccgtcaagaaatgtaatatgaggaattcattgcatccaaagatatgtagatgagttttatgatgattaacaattatcaaattaacaaatgtgcctttccaagtgcaatctatgcttcatttaaaatcctggcccatagatgaaactttcattgtctgccctttctatgccttagcagttgtgcaattgagggcaggccacgtggaaagctgcagcaattaggcagtgagaatgcgatctgcacgggcttaatagatgcttcaactttgggcaggtgggggtggtgtttctaacttcttgttcttgttctcccgccaggcatttcacatcaccaatgatgagcccatccctttctggacattcctgtctcgcatcctgacaggcctcaattatgaggcccccaagtaccacatcccctactgggtggcctactacctggccctcctgctatccctgctggtgatggtgatcagtcctgtcatccagctgcagcccaccttcacacccatgcgggtcgcactggctggcacattccactactacagctgcgagagagccaaaaaggccatgggctaccagccactagtgaccatggatgatgctatggagaggaccgtgcagagctttcgccacctgcggagggtcaagtgagggacactggaggctgggctctctcgacacgttgctcagccagtcactccttcccctgtggattgatgaaataacatcctttgaatgagtttgctctgagcctgtgactccttctgctaggcagagagcgcaccctactctttccgtgacgatgagggcggcaaaaacagacatttcttccttcatggaactggatttggatttcttgaagcaggcagcttcatattataccgatttgttctctgtc

SEQ ID NO: 174 - DNA, 59041 bp, Homo sapiens
ccagaagccctgctgaatcaagtgagaggagagctgcggagcaatcaccatgagtatctcagctcttggaggccgcaccaaaggtgaggcctgggctccctggtttcccaggctctgtttggggctgtttgcttccaagcctgcccctacaggccacaagcactgtcccagcagcaaagggagagcagcatactgggagaactggaaaggaggtcgagggtcctggggctgcattcctcttctgaggcggttggcttttcccaccacagggaagcctctgccaccaggcgaggaggagcgcaataacgttctcaagcagatgaaagtgcgaaccacgctgaagggggacaagagctggattaccaagcaggatgaatcggagggtcgcaccatgtaaggcaaggaggcggggagggaccgcagcaacgtgggggcgcgcaatccgtgggggaccgaccatacctggggatgcgaaggggcttccaccattcagagctccgccaggccatgtggagggcagagcgtgggaaaggctatccagcaatgtcacagggtgggagagcccctgggtgcctgggaaggagaatgtgtggcagaaatggcaggacttgctgggcagcctctaggatggaggccacaggatggcaggtgacagggagtctcggagccaatccttcaggatgcctctttcccccagagagctgccctcaggccggagtcgcgccacatccttttcatcagctggggaggttccgaagcctaggtaagaggtggtgctcaggtggctggtgggtcagccccagggactctcctgcagcttggggccagccctcaacagggaggggtgggcagtccacaggggacagggatgcagccccagccaagggtctgcaatgagtaatttgaaatctgcaggaaggaggggcttctccactgcaccttccttttgggaaggggagtgtaggagtcacttggtccaggcccttggcctggctgtgtggctgtggggcagctgacttccctgctgggcctccgtggctccagctgttaactgggattgaaattgtctttaagaagaagacgacctcccacccattccctgcagggagtgatactgcctctgagatgctttgggcagcttccagagtcacagtgactcactcctgcaggtcaccctgactgcttgagtgtacttgggactcagcatgcctgtagagaggcacgagtttgctctgactgtctcccaagtttaccgtgacatattttgtcagctgaccaaggagaactggcttctctctcttttgggggcttttccataacagtgtctaggggggctctgaagcgtgggcacaccctgctggcctctggaggaactgctcctgacagagaaagggaactgaaattcaggctcgctccttgctccaaacagccggcaggcggcttctcagggggtggtagaggcagtggcggcctctggaagggagggcctcaagtttacagccagcacacagggctacctttagtaactacggtctctctgtcacccctcgatgactcagcgcccactacctgccaggtcccatgctgggcacagaggatgcaggagtggtcaagacaaaggccctgtctttgggcaactgacgtcccagcaggggactcaggcaggaccctagtaaacagttcaatacaaaagcgagaacccccaagtgtgcctgcaacatggccacctctgggaggctgtcccctgttagagatggagattgtggggttggagactaccggaggctctgtgttgcccttgacccaaaccccgatgctccagcccacatcccctccactgcaggacagaagggtctaccctgaccccttgactcctcccctaactctgaggaggactctttgcaggggcccctaactcctgcccggaggccagaacttccaggctgaccacccctggctgtcagctccctgcccgctcgtcttggctgccccctgagttatctgagccccctcagttgctgccaagcaggaggtcccaagcacccagagcctaatgtttcccagccgctgaacaaggcctggccgcgccctctcgtctcaaacttccaccaagacttggggtgtgggcatgcaaggagctggagcaaagagggccccgagggacaggaagggggacagctggcttcggctggctgctgcctgggctctccccttcaagccctcatgcaccttcctggtggaggctgttgagggagatcaggtcagaccccgggctgaggggaagcctctggctctgactggggagcctccagcttgcactggttcagccccaagcacagaggatgggagggctgtcagctgagagcagtgctccgtcggcgcagcactgggaactggctggccaaggagaagctggactttggagaggccatcaagctgccttcctaggcacctgccatgaggagtcacctggggcacttttcctgggggagcatgagggaaataggcagagcatagcgggcacctgatcaggggcacagggggctggcacccctcgtttctgctgtactgggacacctggagcacttgccagccaatcttatttgctatcgttaagggcaggataaagtaggatgacctcagccctccagcaagcctcgcttcactccaccccttcttctcttcggcaggcctccgagcacaagggctcccactggctacatcatccggtaagtgaccgcaggactctgccggccttcctgtgcccactcacgccaagccctgacttcttacccctccagtccctccagggagctcaccggcatctcctgggctctctttcaggggagtgttcaccaagcccatagacagctcttcccagccccagcagcagttccccaaggccaacgggactccaaaaaggtatgtccatggggtgttggccagtcggccagtggggaggtgtgagggcctggtctgggctcctggcagagacagtgctctgcctatcaggactgtggggccttggaggtgccagctttcatcctgggtagggcaggaccctggagagcagggtggggtgaccagaggagatgggctggggtgggactggcagtcccaagtggatgtgtgggtctctgggaggtcctgggccactaacagtgtccttgtcctggggtcagtcctgactaggcctggctaatgggacagagaggtgcaggagtttgggaggggctgggtgtagagtccccctagcctggcagtgggcacccttgacttgacttgctgatggcattgagaaggctgaagttgcatgcaattcaagcaccttggcatcaggcattgcctgggactccgtcagactggaaaggccaaggggacccggaaacaggaagcaaagacacaggcaagagcccgctgggctgttccctgaagctcggtggggtttgcctacacagctgctctgagtggcgcagttccgggtgtctgtcagggccaaaagcaaagaggaaaggctcccaggcagctcctggtccacctctcatgtgtccactgggctgtgtggccaaatctggaggcaggagggagcctgcaggtagacacatggaaccttctcctctctagtgctgccagtctggtgagaacagctaacgctggtcctccccgcccctcctcctctggctacaagatgaccactgaggattacaagaagctgtgagtatgcaacgccaggctcagcgtggttccctcctccaaggaacaagtccaaactctgggtccactgaaggcagctgactacttgccaccgagcacagcccgggaagtcccgcctgcctgacactccctgccagttgcagctgtggcctggagcccaccagagggtaacaagccccagaaaactggatggctgtgcacattgcacgtctgatccgaggcagagcggagaccgcaggaagcttgtaggaggggccccacggatctggggaaagggtcatgggtcgtgaggctgctgctggctggctgtgcttcctgggcttggccctgcacccggccgagcctcaggtgctctgcctggctgcactgggctgggggcctggggatcctcagggtgctgctgtcagtctgagcattgtgtgcctaaatctgagctgcttcttggatagaaaccttcgggttttcccttagtgctccccttggggtccctttcaaagccccccaccccccactgcatgctcagggaggagggttctctggacagaggtgtgaattgtgtctctagttcccaggggaccacatctttccgttgtttgtcccttgcctccatcatccagggttggggagctgctgggtaacctttctggggaaggggagaggctcgaacagggagggaggggagagctggtctcagggaggaacaagtggcatgacctaaggcccaaaggcagagatattgacttgcctcgtcattgttgttgaaagccaggaagccaagctgctgagggtggcagcctatgacaggaaagcgcctctcccctctcttagggcaccctacaatatcaggcgcagctctacatcaggggacaccgaggaggaggaggaggaggaggtggtgccattctcctcagatgaacagaaacggaggtaatggaatggtgccttttgggcatcccggggggcagggcaggagcctgagtcttcgaagactgctggaatgaattgtactggttggggtgacaaaatgcacaacacgtaggccatcagcggtagcccacggagcatgagaataggtgtcattctctgagtgccagaaccacccactcagtgttggaccagctgaggggcccttgagaaccttctgtggggtagaacctaggtaatgtgggtccggggaaaagcctcctcatgtggaggctcttcagggctctaaatcggtttgttagaaagggccctgagacagttgaacaaaaatattcagggagaagccacctgcacagtgccctctatctgcatgatctgcatgccttgggggttctgaatgccccggaccccaaactgagctccaggcatgcacagcagtgggagtgtgccccatgctgctgaaattctaccctagtctctgcgccaagctgccctcgtccacacaggccagcaaagttccatggacccttgcccctcctcagtcctctgtccatggggactgaccacataccacccagtgctggtgaactatgacaggaagggtttgttaagcaccttttgtatgcctttggcttggggcctgtacagcagttgggccctgaggaaataaagccctcccctccctgggctcagccagccaccaggtccatatctgctgacccatctgtggcgcaggaatcacagcaaagccccattgccaaaggccctggcagattggctatcctcagggaacagttcacagtggcaggggcccccaggcctgggtggagcaaggaaaagagccagaagctaggagctgcctagcattgaatgccagctctgccacctgctaggtgagtgctcttgggcaaataatgaaagcttcttggactcagtttcctcatctgtaaatcacagaggatactagcgtctactttcctggattgagaagagcaataagccaatgcgaggatgttggcatctggcgcagagccgggcacatgccacatgctccataaacatgggctgcccttccttcaggttctacatttcctttgaatagtccttggagcaggtgcaaatctggtttctctcaccccttgcctccctggggtggccctaagtcaccccgagtccatcccaggctaggctggcagagcatgtccagcttggcacccatcagatgctcccccatcccgtgtcaccccaggtcagaggctgcaagcggtgttctgaggaggacagctccccgggagcactcctacgtcctgtcagcggccaagaagagcactgggtgagttgccaccaactggctccaggctctaggacagctctcctctcctcagagctccagccttctctggctgatgaaagggtgggtggagagatcacccccaagggccttcctagctgagccttctcagattctcagatgtactttctagaaaatggagaggtctggcggctaccaccagggacagtgaagtgccgggaatggagagggcccaggaccctctgaggtagagcggtcttgatgtcacctgcccacgggctctgcccaaagcattgcctttctgcttcctttccagcagtcctacccaggagacacaggcaccgtttatcgcgaagaggtaagtgtcatcaagggacaccttggaggcctgttactggccacaggaaggccttccgtcagcaggggtgtagtgtgggagctgtggagaggggatgtggatgtgggggactactgtccctgagcagggggagttgtgaggggctgggggcttctgtctggaggcctggcaagcacctgggtggctgtggtagcatatgtggtcaagctcttccatttgccaatggctaatggggctgggcccctgacccaacgtggagcatttccaaggccctctgggagttgttcccctgcccctgttgcttgcctgatgccttgccttctgctctcatccaggatcaaaacctgggccatcaggagaacttcccctgggaggtgactgtgacattggagatgggccctaaagggtgaacagggcttaacagggaatgatcagaacgtcgggatactccagctgaatgagggaggggtgtcaccattagttgagacagggcaccttctggaggaggaaaatattcgggggaaagcaagaaagaaacttctggaaacttgaatttgagggacttccagttgagtggacagggaaggcctctctctgtgctgaggtggctagctggggactgcaaacccaagagaagacagcatgccaactgccccaggcagagggccccagtgcacaggcccggggtgggactagcttgctgtgttggaagaccaggaagttggcaggaatacagagagcagggatggtggcagcacaaaggaagtgacagagaacggggggcggtgggggggtcttcctggctgcatttggttcctgtggtttctgtaacgcagtaccaaaaactgagtggcttaaaacatcagaaagggattctctcccggttctggagaccagaagtctagatcaaggtgttagcagggtgggttccttctggaggctttgagggagaaaccatcccaggccactctcctggcttctgctggtggttggtgatccttggtgttcctcggcttgtacctgcatcactccagtctgtgcgtctgtcttcacatggccttctcttctctgtgtgtctgtgtccagatttccctcttcttacaaggacagcggtcattggatttaggacccatcctactccagtatgacctcatcttacctgattacatctgcaaagaccctatttccaaataaggttacagtcacaggttccaggggacatgaattttggggggacactattcaacccagtatgctgtccttatcctgagctggagtcactgaacccccagcctgggccacctcttggccgtgatcctgaagggttgggtcagttagacgccactggaagcatgttctttgaggcctccaagctctagggcagccaagaagaccacgagcgctgtttctcttcttgctcaaagggtggaggtggtggaagaggacgggccttctgagaagagccaggacccacctgctctggcaagatccactcctggctcaaacaggtaatccattgcgctcatctctgcctggggctggtggctgccatacctgccactcagtcactgaggaacctcagtcagggcacctccatgctgggcttcgagatcagtgtccccatgtgcccagtgacaagacgggacaaagaaatcagtaagagcccatctggctggatgtcccagggctgaaaggagcaaaacagtccagccccccgggagagagcacctggctctggtctgatgagtacgtatctgtgtcaccttaacccttgcaccactgagcctggtggcaacttgaacaccccaagaaaaagtaccatccttggggtttgagagggccagccaccatggcagtagcatgccattgtcagacttgctccttgcactccaataagttagccacattcagcatgcccagggaggaggctctgacatctccagagcctctcacagccaccttctttgccagtgcggatggaggcaggaccaaagcgtctcgggcaatttggatcgagtgcctgccaagtatgcctagccccgctgggagccaggagctcaggtgggtgccgagagctgactctggcttgtgagtgggtgtgatggcttcccgccagcctggctggctggttctgccagctggggagggtctggcagtggggtgatggggcaaggacaggctgagcactggtgatctcactccaggaagggccgtgatttgtcttgatttctgatccctgagaatctgggcagataatggtgctctcttgtctgtggacaactaataccttcttgtactttgtgcagaatggtgctaagtcctgcagggagagccaccacctgctgttgctgctgtttaaagtgcctgcctggattgagacctttgctcaaatctaggtctcctaagagctgcatctctgtagcacccttggaagacccctgcatccagaaggggagagggcctgtccctaccggtcacttcccaggcccccaagggctgttcaggctctcctaataccatagcaatcccccaatttgagctccacagccatttatagacaggtgaccactgtcctcagggttacttcctcagtctgggagggagacagaaatgctggcagagggagccaggagcatgaggccagctccctccatggccccaggcagcagactgccagggtgcttctccttttcactctctccctctcttgatcttctctggttgtctgactctccccataagaactttggtccatagaagatgtggaaaggaagatttgagaattctttacaaggcaatatctagggcagagctccccagtctttttggcaccagggattggtttcgtgaaagacactttttccacgggacggagcaggggatggtttcaggatgaaactgttccaccttagatcatcaagcaccggattctcataaggagcgcacaatctagatctctcacatgtgcagttcacaatacggttcgcgctctcatgagaatctgctgatctgacaggaggcggagctaaggcagtaatgatctctagcttacctcctactgtgcagcctgattcccagcagaccacagactggtactgatcctcaggctggggttggggacccctgatctaggggacttggcaattgagggatatgggggcaaaggctgccacaacaaagtattgtaccacaccctggggcgcttaaaccacagaaacgtatcatctcccacttctggaggctagaagtgtgagatcaaggtgacggcaaggttggttcctcttgagtctctctccttggctggtagactccatcttctccctgggcccttatatgctcatccctgtctgtgtgtgcctgcgtcctaatcacttctgtttttttgagacagagtctcactccgtcgcccaggctggagtgcagtggcacagtcaccactcactgcagcctcgaccttccaggctcaagagagcctccagccttagcctcctgagtagctggggctacagtcacaggccaccatacccagctagttttttttttttaaatttttgtagagacagggtttcaccatgttgcccaggctggtctggaactctaggactcaaatgatcctcctgccttagcctcccaaagtgctgggattgcaggcatgagccaccgcgcccagaccctaatcacttcttataaggacattggtccaactggattagggcccaccctaacaactgtattttaacttagtcacttctttaaaggccccatctccaaatgcagtaacattctgaggtcatgggggagttaagacctcaacatatgaattttgggtggcacaagtcagcccataacagtatacagttctcatttctccttatttctcttttaaagaaaggcaataaatggtttcaggtgcctttctgtttgttcgtttgtttgttttgtttgtttttgagatggagtctcgctctgtcgcccaggctctgtcgagtacagtggtgtgatctcggctcaccgcagcctccgcctcccgggttcaagcgattcttctgcctcagcctcccgagtagctgggattacaggtgcacgcgaccacgcccggctaatttttgtatttttagtagagacgggtttcaccatattggccaggctggtctcaaactgctgaccttgtgatctgcccacctcaggctcccaaagtgctgggattacaggcgtgagccaccgcgcttggcctcaggtgccttttagaagataatataggaggctgggcatggtggctcatgcccgtaatcccagcactttgggaggccaaggcaggaggatggcttgaagccaggagtttgagaccaacctaggtaacatagcaagaccccatctctacaaaaaaataaaaaataaaaattaaaaattagttgggagcattgatgtacacctgtagtcccagctacttgggaggctgaggtgggaggactgcctgagcccaggagtttgaggctgcaatgagctgtgaccgcacccttacactctagcctgggtgacagagcaagaccctgtctctaaaacaagaaaaaaaagagagaaagaatggaggagaattagattgtgctgtattatagatttaaaaggcactttgacatttattccacaaaattcctttcgatgtttaatccccatcatatggttgtcattgcaaggtggctttttaagtttgctcaggttgccataacaaataaaggctagagattcagggtccggggcaagctcccaacaggaggctcagcttgatgcttctgatagttctttcctccaattctggtcactcaatatttggagctcacccaggcagcttccaggaaagctgctggctgatcctgaccctggagggccgtcttctctgaccctaccacgttaggtgctgcactggaccaagcagccaccatcagtactcccaggcccagctcctatctgcctggtgtctgagaagcccagcccgtgaggaacaatgactcaatcaaactcagggtcctgcagcacttcagaaaaggctggtttgtggcagagtggaagaggagaatgtcacagccttgtccccaggcacagacctatcgaggctaccctctccccaccccctgccctgccctgtttcccttagctacagtgcaaaggtcagctcctcataactcttgccccccttgcaacctgaacccagtttagggaccctctcttggagaaactggttctacacatgcaccccttctcggcccccaggcctggctgctttacccgaagcactggtcaagcttgcctcacctgaccagggcatggcctcctgggtcccggtcctaggctctgcccagcatgctgcctggcagagcgtctggggagcagggagtaggagcacagcttctggcacaggacaaaaccctggctttgcatcagactgactgtgtgaccttgagcaagtctcttcatctctccatgcatcagtttccccgtggataaaatagggagagcagtaatagctacttcccaaggctgtcccaaatgctaaatgagatcgtgcacctgaagtacttaccacagtgcctgggtgctggtatcctcgggggctcccagtcataggcgtgctgagctgcagggcccttattcaaatacaggaagagatcaatatctccacctgctggcatttgagggaaatgtggccaaaggcagtgaaaaggaggtatcccctcgccccacatccccgcctcctcgctctttggcagaatgagtcacacactgtttggcacaggccacagttggtcgcattcccacaggtggctgtgatcagttttgggcttcaggcttcagcagatgcctgcctctcttccttgggtgccttccaagggtgtgcagccttccagcgtggtcctggacttcagcttggactggagctgtctgtggttgagagtctggggagatggtagggtagcgggttgtgggggaggagagacccttgtattagtttactggagctgctgtaacaaggtaccagaaactgagtggcttaaaaccacacgcatttatcctctcacaattctggaggctggaagtctgagatcaaggtgtcggaagggccatgctccctccaaaggctctgggggaaaatctgttccatacctttctcttaccttttgttgcctgcaatccttggtgtttcctggcttgcgcccgcctcactcccatctcggcctctgtcttcgcgcagccgtcttccctctgtgtctgcccacattgccctagtctgacatcagtcactggagcaggctggggtgacactttgttcccatttcctctgtgacagagccagaaacgccagtgagaaaatatgttgtgcttgcctgtgacatccctgttccctggcaccacctgatttaaatgaggcagccaggggttttatactgtcatcataaatgacatcatcctcaacaacgatgtcatcgtcgttatcacgagaggagatggggagaagtcagagctgtctgtgtgtctagggcccctcctggctttcatgatgggagaggccttgtccttggtagcccttccatttccctctggtcactttgagcactccaggccctggccagggtggaagtggagggacagagatgagcagcccgctgacccagccctccatggctcattccttgctttcaccttggccactccatcccctacccctcctgggacccctgagtggcctctttaaagtgccagtctgaacctataaaccccccacctccacttcaagcccatcctgcatcttccctttgccataccagatctagtctgtacattcaggacccctgccagcctctacctcctcctcctcccccgatctcccttcagctggcctgggtcgggctatgcctccatgaagcttgtccactgctcccatggctaaacctgttctgggccctgcagcacagcaaggtcagtttccatgcctctctgcccctgcctgaccctgctgggcccagagcttcaccagggcaggcctggggctcaggcttgtctgcacttccagggcccagggacaaaggcaggagtgactgcaatgtggcttggaattaggctttgctccatggacctaaggaggtctggtttggggtgaagggtccacccccagaaagcctgggagctctatattctctctggccctggccacaccatggccaagcctgctgggcgtcatgccttgcagtacggccagagaatgcatcagacttggagggatgtgtgtccggggtggcctgtggtcatctgggggagggctctgagcgtggctggcaagaggaaagctcaaaggggccctttgtcctcatccccgagtctgcgacatcccctcccactggttttcattccatatttggtctgtgggttttctcagtctctcgtacccctcagtccccaccagtccatgaatgcagaactacccctggcctcacaaatggccactttggataccctggtggggtcacaggctgcggttgcccctgcaaatggttggtagaagcacgggttgggaggtttcatttctacccagaagggcccttgctgtgcctgagggagggctgggctcaggtcaggggtgggagaccggggaaggggcctacaggtcagtggcccgagctcagctgcagcaccaacaaggctcaaggccaaggaggagatgagagcacatcaaaagggggcagtgggtctgggcggcccaccgcactcaccagcccaagaagggggagacttttctcacctgcaacccactgggtctctcctttggcccgcagctcaagaggtgaggaaattgtccgcctgcagatcctgacacccagggcaggactccgcctggtggccccagacgtggaaggcatgaggtatgggggtcctgctgctgtcctggctccctggacaccattctagagatggaagcagcagcctcaggtggcaaatgatgaggcctagggccggctctgccactgtagggccaacaggttgatgggaggcatggtcgacctgggttttctgccccatctcattctttcactcagaaaaccattatggagcaagcgcttagtctgtgtaagggcacaggcccgaccctgggacacagtagtgaacaggaccccctggctggaattgccatctgcctggtgggggaggcagacgccgacatgagcatgaatgaggtcagccagagatgctgtgtgccaggagcccctgggaagtgacagctcaaccctgccaattgctgaagatgggaccagtcagccgtgctggggatgttggtgggggtgggaggaggattgggtctaaggagcccgtgaaggccactgaggccattgccctgcctgtgtgagagggccactgggaatagagtggggtcactgggtcagagtccacagctctccatgccactaggctctgtgctggggaggggtgggtcaaggaggccacaaccagcagggagcacgaggggctcagcctctgccctggggtgggggtcagacagccaggtgacatgcaggcaggattcgggggctggggtggaggctaggagagatccgagcagggagactgggcccctaccttgtgaaggccagggactggggagagaagcgggagtgtacactgaaggtcatcccttaatccctggggtggcaggaacttcgagcagaggcctctcaacagtgtggtgggtgggagtgcttggggagggcttcctggaggaattgacatccaagatgagtcctgagcgatctctaggtccctttaccctcctccttggctcctcccactttaattctgcccccaaggcaccaagtcctgtccactttattttagagatgtttccatccctattgctctgcccctggcccaggcctccactgctactcacccagttgtctgcgaccgtttcctactgtcccatccctggactcccttccacatctacctgggtgatgtttccaaagggcagaagtagttatgccagccccctgcagaaagccctgcaaagcccctcccactatgctctgcagcctgaactcagtacctggccccacctgcaggctcctccctccctgggcctttctctgtgcaggctggaggctctgcctgagatgccctttcccctcttcatctttctgttccacctcaaatgtcctgtcttctgggtcatgtccttctcctgagtttcttccccaggcagcatctgagggcttgtcgattctgcatggcagcatccattctgcatggatgtagatacaatcactatgcccattttacagattaagaaactgagaccctgaatggttaagtaacttgctcaaggtcacatggtccagagcaggcagatccgctcagcctgccctactcccaccttccaccttctgcaccatagctcattgtactagttggggcagggagcagggggacagagaggggtgatggaaagacttggcatttgctgagtgaactcatttgacgagtttattcgtaggcattgaagtcaaaatttccaggagggaggtattttaaggtttgtgattgaggtttgagagagtgattagggctcaagagatttccacgttatatgcagacagaatagagctgaaatcatgagcgtaaactagctttacatggggctcatggtgagccaatggaagctgggcaccgacctcagtatgcaggtggcagccacctggccagccctcctggggacagctgggcgagggcagtctcttctcgccatgttgagagtgggcctcctgagggccagttgggagttagtgggtgtgcaggccagtataaaggagaggcaggaacaagtggagatccctgcttcaagggtggcagttgacaccttgggaggggaggagacagcccagcaagtggtggagcacgccaaagggaggagaaaaaggcggagaccaggaaggtgtgtggccagggaggtaggcaggtggtgttgacaggatcaagggaggaggggtggtgagaaggctggagtggcccactgggtcagcagtactgaatggtggtttgaaataatgatgggactgtctctcctggatttgacaacatggggctccctgaggacctgaaggagaacagaagggggcttaaattaggagattaggatcagggatatagtccagaactcaaatcccagctactcctcttattacctgtgaaatttggggcaaatcacaggggctttgtgtgcctccgtttgctcatctgaaagatgggcatgggtgataacagtgcccatatcctggggttgatttgcagagttaatgcatataaagtcacgagaacaggctcaaatgctcaatcaacagtagctattgccaggcacagtggctcacacctgtaatcccagcacagtagctataaaacaacaacaacaaaaaacaaaaaacagtagctattagtaatgaagttttgataattggccaatctgtcaatcagcagggtttgtttgtttttggttctgttttttaagacagcatcttgctgtgtgtgcccaggctcaagtgcagtggtgccatcacagctcgctgcagcctcaaccttccaggttcaacctcccaagtagctgggaccacaggcacacaccaccactcctgactaactttcaaaaatatttttgtggagatggagtctagctgtgtttctcaggctggtcttgaactcctggctcaagtgatcctcttgcctcggcctctcaaaatgctgggttataggcgtgagccactgcacccggcccagtagcaggttttaagctccgtggagacagctggcgtttgaggatgaggtaacagcccacacctgagtgtgaatggctgctgcatggttaacttccatttctttcctccataggtcttccccaggcaacaaagacaaggaggccccctgctccagagagctccagagggacttggctggtgaggaggctttcagggcccccaacacagatgctgcaaggtaactcagtgcaggaagcagacacttcattcccagaacacggagcccacatacacccagctgaaggacttccatggcctccggtgcaatgtcaatggatgcagctggggccaggaaggtcctgttcccactgttcccccagtacctggggtactgcaggtctttaatgaacatctgttgaaagaaagaaagaatgaatgaatgaggcctggagggaggtaggcccctgccatgattcctcagggagccagttagagagcaggaccaaactccagggcaggctatccccagctcctggcctgtgctgagttccttccattcccctgaagcttccacactcactgtgcttttactgcaggacaaagcagccctgccaatggccagggcaaagcaaggccaccaagctggcagtctgggagagtcagtgaccaaagtatgtgggcccccatagagcatgtagcggagactttcaggatgacccgtggactaagggagacattgtggcaaggggtgaggggtccaggacgggaagttggagccatagcggtggatgatgagtccagatgggatgattgtccccagtcgctgcacagccagcccactgacctgtcctccaagccagaccagtgccaaatgtgtctggtgagcagtggctgcaggctgggcatttcttcagtgagaacctggtagccagttacagctaagaacccacacacccgtcttctcagtgtggatccctggagcccctagctggaaccctgagccctggaaatgaggaaaggaatccctctatggcttattaccagacccacatgtcttgccccttgctctgttggcaatcagctccccccaccaccaacgaactaacctcctcctgactttccaccttgctcccaaccaacccatcaggtttggaaaaaatacagaaatacttcctgttagagtcaacttgggcttggctcagctctggtcagagcagcacagagtagcagccaaaggcctgtgcttctggtcttgaggcccactctcatggcatctgggttagatgagatcaaaacgcaactagagtcagcaaatactccacttctcataacaggtcaagtgcacagttgagtgatggcaatgtgggatccggagccacgggctcccggcctgaaggcttggctgcagtagacatcggctccgagagaggaaggtgagctgcccgggggaggcaggttctctcatgcccctggtgacagaccagggtcaagctgccaggctgcttgggctgctatgggtggggcactggtcacttcctatggctcctgtctactgcttctcccacactcccacattccaccacatcctgtgtccttgggctttccactttttggaatcttgttcatttttctgatccctgccactggccctcaagctcctccagagtaggcactaggcccactcacagctggaggcccagccctcacatggtgctggtcttgggctggtcaaatgaacgtgtagggaatacatgaagggacaaattaatgagtgaatgactgaatgatggaagagtcggcaccttcttacttcttggttaagctctgaggaccagctaggaggccctttgctcctgctttctcccttctctccttttcctgccccatccctaccccaggcagctctgctctgaggttcagggagaggaaaagcggtagccctggagagaccagcgtgtccagctgggctctggcttcttggacctggagggagtcaggggccactttctcaggtgatttgcagagtggcaaggtccctcttgtccctaagtggttccaaaccaagcctgaatcattcttggggcaaaggctaggtatgcagatgttggcataaatagtttagctccaaactatgctagagtccttctggttcagagcagatggctagggaggagtggcaaagccagtgtctgcaaagagctacaaccgcaagatatcatctgcctcctgcatcctactgcagtctggccaaggagggaatcctgtggggaaggccctgctgatgctttcctacttccctcagcacacccagggcccctttccctcactaacttcaatagtttgcaattcatgccatggaaccagagcccgaattctaaatccaggcccacaagtcaacacaggaaggggacagcaggtcctggcctctgaaaccactgtctccgagcaggtccaaggagaggccaccagagactctgttctttaagctgccactaatggggaggactccgctagagccctgtccatgcagcctgcatctttttgccatctgcagaggcattggagggatctttttaaaaataagctagatcacatttctcccctgctaaaaccttctagtggctctccattttccttagaatgaagtccaaaccctttcccatggcccactgggtcctgcatggcagaatctttggccttctatccagtcggggctcctgctactctccccacagtggtgcagcttgactggctctgctgatggctgtcgcggaagagacttctggtctactgtgattgggtggctctggtctcctccatgtcaccccgcctgcttatacaccctcataacatgaagcctgtgctgtccactgtttccttaaaatgaaaccaagcctcaaagttacttgtaaagtcatctgaagaatcttctagattttcatgaattttaacccagtcttttacagttgtcttacctatatagtagtccctaggtatctgtgggggattggttccagaacctcactcatataccaaaatccatgcatgttgaagtccctgatataaaatggtgtagcatttgcatgtaacctatgcacatcctcctgtaccctttaaagcatctctagattattataatacctcatacaatgtaagtggtatgtaaatagttgttatactgtattgtttagggaatgatgacagaaaaaagcctgtacatggtcagtacagatgcagccatcctattttaattatttttcccacatctcatctcatcctctcctctcctctcctctcctttttcagacaggaccttgctctgtcaccagggctggagtgcagtgctgtgatcacagctcacagcagcctcaacctctggggctcaagggatcctcccacatcagcctcccaagtagctgggactacaggcgtggaccaccacgcctggctaacttttgtatttttggtagagacgaggttttaccaggttgcccaggctggtttggaactcctgggctcaagcagtccaccgacctcagcctcccaaagtgctgggattacaggcatgagccactgtacctggtcccaaatattttcaatctgaagttggttgaatccacagatgtggaacccacaacatagagggctgaccacacttagtttgactataattttcaacaaactcctttattgtttttcctttttttttttttttgagacggactcttgctctgtcccccaggctggagtgcactggtgcgatctcggctcactgcaagctccgcctcctgagttcatgccattgtcctgcctcagcctcccaagtagctgggactacaggcgcccgccaccacgcccggctaattttttgtattttttagtagagacggggtttcaccgtgttagccaggatggtctcgatctcctgaactcgtgatccacccgcctcagcctcccaaagtgctgggattacaggcgtgagccatcgcgtcctgccttgtttttccaaaggaaaggttgtttctcatggcaacaaccactctccttttccattcattttcatggatttacttaatcatcgaacttagtgattcttctccattagtggcagctcaaagaactgagttgctgccccaggggcctttccttggatctgctcagagacattggtttcagaggccagggtctgctgtccccttcttgtgcaaatacaactggcataaagaggtctgggaccaaacaagagcacctcttagtgagtgtgctggttagtggagggcacaggcttgtataggcagtgattgttcagcatgccgtgagcatcagtctgcctggtttacagagacacagagaatgtgactccaccctgagaaggttgggtaagacattccccactaaatccatattgagtgggtgaatacaggtggactgggaaggtgcactgcttctataaacagccactgggccctgtggtaacaggaacacattagcacatgttatggcccaggcattattcaaagtacttggcatctatgaactcatttacttttctcagaatacttacgagacagacatgattagcatccctatttcattgatggtaaaactgaggcccagaaaaaaaggtcaggtaacatgcccaatgtcacacagctgggagatagcaaagccatgatttgcaacgccagagggcaaccactatgccacagagccccaggtgtcaggctgccttgagatataaatattgttcctcaagcatccatttgagcagcttcttggtcctcatcatctgtggggggcaggatccactttctcgggagagggtagacatacagacacaaagtcctgaacctggaccaggtctggccttctttcacaggctgtgtgcagctgctagctttgcctctttcctggaagaccaggatgggcacagtgccaactctcagtcctgcaagcctagaccagcagccatcaggtaaggttagggccactgccctagtgccctatcccattgccagacacagcctttggggcccagcctcagctgcagcaccccaggatccccctcgaacttctcagctccatgccactttcacatcaggtgatcacagcaagacagggaactccagggggagctctgaccaggggcagtggaagaagagggatgggtgatatgtctgctcacccagagagcccagcaccaacctacatggacccaagctgaggtggcagagaggagggcatctgaaggcagagcctgggaagagatcctgctaggaggtctcagagaacctctgctgtagggactacagccaggtttagcaagcaggagtcagggagaagattcccaggggcagccagcattagagggctcagttcccaggagcacaggaccggtggctgggatgggcaaaaatggctcctggggcacaaaggtacaatgggaagaagctgtgcattcccatgctgtaagcgtctgccctgtttcacccaccaatccaccagtgggcatggccactttgctgtgggtgtgtggagcatttggcaagtcctagtaaggaacgatctttcttaactcccataaaccctacagaggtgtaggtcaggtaaggatacgtcatgctcagggtcaggttccagccgcagctgagggctaaggggaatgggtggacgtggggcagggagctggaagaacactcgagagatagcaggtaaatgagacatggctttactcagcagcagctctcttacacagctttctcaaactagctttctcattagcagcttactctcacaccgtctgccctgtcttggctgcttagtccggtggcccctacgcacagctgcgtggccagctctcccttgccttcagggtcagcagcttaattctttctctccctgggcacgggcaagccaagctgtgtcctggctcccctctgtcctggctcccctctgtccacctgcaaagacagacagctcttgctctctctctttctctaggttcccgtgcacccgccatgtcaagctatgttgagctgagccaagccccaagagacatgtcccccatacacagcgtcaacagggcagttataccttttacagacaatagtggtttagagccaagtatgaacttacataaacaggttatataagaagtggaggtgtgcacctgtgcaccagactcattgagtcatgcaggcctggatatccccctctgcctattccttgaacaaagcacatccaggtaccttacaggatactagaacccaaaaccaggagacttccccagggaacccaagttggtcaggggcagtgtttgctcttgaactcaggtgctaaggccatgtccaaagctgacatgaggttgtcacacacagtggcatcggtgccacactaatgccaggactgagacaccagcctttactggaagacacagttcctccctttctggtgagaaggcagcctggagggggaagacctgggccccagccttctttggtctgagatctcagcaggcctgtgtttccttcctcagctccagtgccacttcagtctctgctgtccctgctgataggaagagcaacagcacagcagcccaggaggatgcaaaggcagacccaaaggggtaaggcatgagcagacagtgctgaacttctggggtggagagaggcagcttgggctgtgtgtccattggcctttggctgggaaggtgaggccagcaaggtttgtgagctggcctgaggcacatagcaagggcagaagccccaaccagaaccctctggcttctggggccagggagctttccactaaactgttgccttggccaggaaatacatcatagtcagaaagggtctttcagtcagcaaccactctgacagcaactgccttttgctggaggctggagcatgcagacaaatcagaaacacctctgccctccaggaactctcaggcagggggtgggcaaaggctggtccagattagagcaatacatgagcgctagagcaggggaagggggcttcatggggactgtatgtagctggatgtggtcagcgatgagtgtccttgttggggagtgctggaagaggaggctcagtgaactaggtagggcttgattggcctcttgtactgtgatattggagtccactgtgtgcacagccctctactcacagtgtctcatacggttctcctcacagtctctcaaaggtttatgcctaattacaacaaaacccaaaagcctggagcctaggtctctgtgcctcctgggaaggatagtgctccgaagaaaacagccgcagctgagatagagtgatggcagtgaggagggtactacttaggtgggtggaaaaggcaactcaggcgatctcctctaaagaggagaaggagccaactctagaaagaacacggtggagagagctatagataaggaaccacaaaccaactaaccctgaggtgggaacatgcttagcatgttccaaaggacagagtggctggagcttggccagtgaggagggccacagatggagcagggccttggtaagccatggttaagagattggatcttatttcaagttttaagccaaaggggagtctcatgtgatttaggtgtttaaaaggtgaatgcatgtttgcattttcataccacattgctgttgcttttttacttaaaccaagatgctgggggctggggtgggcaatggatatctaaggtatgaggccttattgtgtttcttttctcattcgaattgcactgacaattaacaatcagagtgaaaacaacagctgacaccaatactgtgctgtgctaggtgccttacagccttcccagcaacttgtgagatgggtaaggtgggaaactgaagcatagaaagattaagtgacttagccaaggccttacaagtggcagaactgagttccaagggaagaggctctaagaaaatcctcaggagaaactacgaaaaactagtttatgaaatcttgtctttggagcctagtctcaagacccagaatcagtaacttacagctggttaacatggttaacatgctgtgtgatctcaccttaattttccccaaacgtggaaaaggataaggcttcttattatgcaacttgacagaggagaaaattgagggactcactcctgtaatgaacacacttaggaacagagcccagatccagccaactctagagccaggctcacgctactttcctctgatgtttaaacgtctgcaaaatcagaggtgttttttttttttttttttttttttgagacagagttttgctttgtcgccccagctggggtgcagtggcgcaatctcgactcactgcaacctctgcctcctgggttcaaacgattctcctgcctcagcctcctaagtagctgggattacaggcacatgccaccacgcccagctaatttttatatttttactagggatagggtttcactgtgttggccaggctggtctcaaactcctgacatcaagccatccacccatcttggcctcccaaattgctgggattacaggcgtgagccactgtgcctggccaatacaaactttcttgattacagtgtttcacaactctggctgtacttgagaatcacctaggaagtactgaaatacactgttgatgaaaaaggccatactctgtaaaatatttgaagaaattctgagccaaatgttaggactatgacccgtgacacagcctcaggaggtcctgagagcatgtgcccagggtggttcacttacagcttggttttttatgttctagggagacataagacatcaatcaatacatgtgaggtatacattagttaggtccagaaaggcctaggtatacattagttaggtccagaaaggccggacacctcaaagctgggagtgtggtgggggtgggggtgggggtggggttccaggtcataggtggattcagagattttctgattggcaattggttgaaagagttgttattctctaaagacctggaatcaatagaaaggagtgcctgggttaagataaggggttgtggagaccagagttcttatataggtgaagtctcataagtggccgcccttagaagcaatagatggccaatgtttcttattcagacctttaaaaggtgctagactctcagatcagaaaaagtcctggaaagggaaggagattctctacagaatgtaaatttcccccaggagagacagctttgccaggtcatttcaaaatatgtcaaaaaatatattttggtgtaaaatacttcaatttctttcattacctgctgtctgtcatgtgatgctatactagagtcaggttggaatttggcatattattgcttcaaggagtctgttttgtcagtctgaatatctctctcaatgttaatactggtcagttgggcatgaattccaaagggaggagaatatattgaggcatgtctgaccttcccctttctcatcatgacctgaactagtttttcacgttgtgtccccttggctgagagaagtgtccattcattcagctggggagcttagaattttatttttggtttacaacacaacaaaaacttcccgaagtcccaggtagagatttggattttatttttctggggtgggtctccatcatgtgtctttttcaaagctccccagtttgttctccttccaggctaggtcgagaaccatcgttctcaggtagtggttctgacccaggggcatctcccaaagcttccagcctgctacgatacaatgtctggagccatttttggttgtcaaaactgggagtgggagacactactggcttcttatatgcagagatctgggatgctgccccacatcccccaacacacaccatagaattatggggttcaaaatggtaatagtgctaaggttgacaaaccttgctgtagagccttgacgatctatttgggaagacagcagggacggaaaagaaaaagggatggcacagaaccacacccctcaccttccccgaaatctgggtagcgggcacaggacgtgtgcgcctgcgcgaatgcgcgctcgccaccagcgtacgcgacgcgtgcgcgcctgtgcacctcggcgagcacgcgcccgtagtgagtacgcctgcgtaggccgccatttcttgaagccccgaactcggtcgcagtgcccgccgggaaaatgcgaccgtccacaaagtgaaatggccgcccgggacgagctcggcctcggcggggattctcttgaggccatgcccgtgccggccgccagaggtcgcccgaggatcacgaatgggcccgaggagctggctgccccttcccccgcgtaaggtctgaagccgcggccagagtggctttggggtgaccgcgcgtggaccgtcgccggcgggaggaagcgcggtcccgcgaggggccgaacggggcccctgcggcttgagcttgtttcgcagggagccctggggccatggcctctgggacactggacacgggtcgtcagggctgcccagggggagggggtgtggacgtgcagacagggaaggcagctggaccctccaaccacgctgggccctcgggctgaccggggctggtctgtggggcagtgaggaggggcttcgttccctaggagtttgatgagggagcgccatgggggtggcgtcatcctgacatcccgcagggcagtggagccttactttccctaggttacaacacagttttaactgtcccaaactgtggggactccgccctattccatcttgggccgctccatcacactacagggagaggcggtatagtatagtggttgagagcctggactctggtgctttgggttccagtccaagctctgtcacttacaagcaccgtgaccttgggcatgttactcatcttctctgtgcctcaggttcctcacgtgcggaatagtggtaatcatacctcctaccatatagggttgttgaaatggccaaatcggtttgtatatgtaaagcctgtaggacatttaaacctgcgagctaagtgaagcagcaccagaggaatatctcctcctctcagaggtgttcagggacacctggaaagctaacttaaccagctttattggtttgatttcatttgacatgacacgatatctcatcttcttcctactaaacttttgtcatcaaattttccatctagaacatgctgttttcctcattatgttgcaagcatgggcttctcgtttatattttttctgcatgaggatcaggtgaagtttaggcaccacatttcctcaccactggcaaccgttgttggccagtggaggcagtacaagggtggaagtgtcagctgggtgcagtggctcatacccacctgtaatcctatactttgagaggccgaggcgggaagaccacttgagttccggggattgagatcagcgtgggcaacgtagtgagacctcatctctacaaatattatctatatctatatatgtatatgtatatgtatatcatatatatgatgtatatctcatatatatatgtttttgaaacaatgtttcacttctgtcgccccagactggagtgcaatggggtgatctcggcttactgcaacctctacctcctgggctcaagtgattctcctgccttaacctcccaagtagctgggactacaggcacacaccactgcacctggcttatttttgtagagaggagtttttgccatgttgcgcaggctggtctcaaactcctgacctcaactgatccacccacttctgcctgccaaagtactgaaattacaggcgtgaaccactacgccgggactacaatttccgttttttaaaagaatggaagtgtgtagattatggttgtgttaggagttgacagtggctgtattaggctactggatctttggtccaattacactcagaaggaaaggcttcagagaaattaatccaaaatccaaaatcccgttggtcaccatcccctatgttaccttgcctatctctaaccacttgacttccaggaagttcatgaggagctcggacaggatagctgggaagtaattcccctggatgttacattgtccagcagagcttcctgtgagtgtttgcctaagatttcctttttatgacccacataggtcatatgtcctaaaatcacagtggccctgccacaggcctaggaaagaagaagccttgttcatccatttgtccctgtgtcacaatagagcccaaatttctctttgtggataatcctggctctatccacagacttggtgagggcaacctctactagtgtatttctacagaggacgtgggacaggacgggactctgattaaatccatagtaaagctaactcagggctaccacagtagggagacaagctcttcaggccttgtatgtttgtctttggctcaagcaagcatgtcactgacagagattgaatgggtgtgtcagggcaccctgctggcaaccctgggactggtgttacctgtgcagaccacttttggatctgcatgggctgcagcagaccctaagggtggaagcagcacagagaagcacaggcccagtgggatggttccccacagttactgtgtggcgtcacactcacttgcctgcagttctgcctggtgcagctggaggtggcaattagcttgttgtgcctgctggagaattttagttcccttgacctccacctgaggctgaagaatcatgttgctttcagggcatactttccaaaaagtgtggcctctgttggccttgttattccagcttgaaggcaggaagcctgcctagacaaagttaactcctatatacaaagagtcccagggtagtttgtagcgtgttcttgtctcggggtagcccccaccagctattgaaggtaggctggtgatgttgggaaggttatattcagagtgagctaggatcgaggtgatggcgaagtagattttcattctgaaatgctgggctcactctcttagtagcccaacttggtgtttgcccctggcctagtagactctggaagcagtaccttgcacctcggtgtggggctggtgatgggaggggtgtggaagtggaggatcagctagcagcctctttcccacggtacccagattggagggtgcagtgcaatcatggggtgaggccagggaggacccctgaagagctcgatgcctgagacatctgggggaagccctgtccttcttgctggattcaggggtggcaaaagccaaaaattggagggccaggtgcaatggcacatgcctgtaatccctgcactttgggaggccaaggcaggaggatcgcttgagaccagcctgggcaacatggtgaaaccttgtctctacagaaaaaaaaaaaaatacaaaaattagctgggcgtggtagtgtagacctgtagtctctgctactcagaaggctgagacaggaggatggcttgagcccaggaggcagaggttgcagtgagccgagatgatgccactgcactccagcctgggcgacagagtgagaccctgcctccaaacaacaacaataaaaacatcggaggcttcggcttcatctattacacatggaggcctgttcagtgagaagggagcagcgatgctgggctcctgccaaggaggagactgtctgctccctggaattggggctgtgcctggctcctttctgccccgctttcagggatatgagtccctccaagtccacaggaggtgacagccagcttgcgtcctggggctgaggcagggttagtttcagagcacttttttcataagggtgcttattcttcttcagggccttggctgattatgaggggaaggatgtggccaccagggtcggagaggcctggcaggagaggcctggagctccaagaggtggccaaggagacccagctgtacccgctcagcaacctgcagatcccagcaccccagagcggcagagcagccccagcggatctgagcaacttgtcagacgagagagttgtggcagcaggtaagggctgagctgcagtgggctctgcctctggagcccatgtttttgttgaggtctgcgacccacatgggaaccacttccccacaccctgtgccaatacccgacacattgcacacccaggctcctgttctgtgagtgggtcatggtgattccctggtcctagagcagtgtcatcaggcttcttgtggctcaaggagctgggaggggactgtgataggaggatgtgtctgtccccaggtgtgagaagccctggctaattcccaatgcatggggcaggaaggaaggctgtctctcagagtacaggtgctctacaggtgggggtcctgggcagagtgagggctatttgtgtgggtaaaatgccattgtcagagaaggacagagtgtgaaagagcaaaaaaacaggagggtaaaagtgcaaaagtgacagagtgaagcagagagagagaggccagagggagagaaagggagcatgtgtgagcaggcatgagagagtgacacaggatgtgactggccatgtgttggtgtgtgccactgtgcatgagcaagaggacaaacgtgcctgttactggagctgaccatgtggcattggtgtgagagtttcaagtcaggctctcttgaaggcatcttgcctgccagcgcaaacactgcatgtccttgcagctctggacacgtcaacaggccagtgattccaggggtgcaaagcgaacagtttcttacacaagacagaaatgtagaaggagagagctaagactcatattgccccgagagaggagctagtggaatccagcagggcatctgctgtggggagcaggtggagcctggggttccttttgcagggatgaaagaaacacagtcatctgccttctttgttctggggcttcttgtaccacagaggttccataattattaatagttaggttatttttagggcctagctcaactgttagataacaagttttaccttctaagaatatctagcccatctttgattccttggctccaggccctggagggtcccagtccaaaaacagagtgaacaactttggacttgctgtcacattgtgtggcttctagaactagtcagtgttccatgcagaaggggtataaaaagtgaggcttgtggatgaaggaggaggcgagtggttctgggttttgttttcgttttgcgggggagtgtcaggaaaggctttctttacagggagagtgatgttggagctgggtttggaaggctgagggagattttgccagatgtgccagacgtgcttgggaaggcattccgagtggaggctcacaaagtgtatagggaacatccagtcaggtagccatcacaaaggagggttaatccagcctggcttggcaggaagcaccaagtaggggctgggcaggcacctgctcctaggctgaggagtgtgacccacatcctgagggccttgggagccaccgatggttttcctgcaggagagtgccacagccagactcgagtccaaagaagatccctccattgccctgtggaggaccaggccaggggagtatacgacgagacaaggcaggaggccatattggagactgtttgcttacaccaggggcaaggtgatgaggctgcaagtatttttgaattattaaaggtaaaagcgggcttggcgtggtggctcacacctgtcatcccagcactttgggaggccgaggtggcagtatcgcttgagcccaggagtttgagactagcctggggaacacagcaagaccccatttctacaaaaaatttaaaaacattagccaggtgtggtggcacatgcctgtagtaccagctacttgggaggctgaggtgggaggattgtttgagccttgcacgtcgaggatacagggagccatgttcctgccactgtactccagcctgggtaacaaaacaagatcctgtctccaaaataaaaataaaaaaaataaagataacggtgagggaaaagtggtagccaaggttgctccccagatttcagggctaggcaattggatgggtggtgacaggaactagctgagggtaaggagtttgggggcaggcccgctgagagatgcacagagatgagaaggtcactgggccatgccgaatgagaagtgcctgtaggggctccagccagtgatgtccagtaggctactgagtaaacaaatgtggagttgagcaaagatctgacctggggctagagagctgggagttgtcagctcataggaagtcactaaagagaatgcatgaggttgcctggagaatgcctttggaaggcagtgtgtacaaagcatgtattctcggcttttctctgcagacttccagggacagttgtccagccaggcccttggctgggtgggtgagtccacgtggttcagggatgctgagggaagctgcttcatcagctgacatttctctccattttctgctcttcttttgtctcaaaaagaaaaaaagaggggatattaattattgatcccctaaaaccctagctgaatatataaaatgaaaagaagtaaaaatatgagagaagcaaaggcagatggaccataattttggaaaataattccaaaaggtcttaaggaggaagaggagctacagagaggtattgagaaggaaaattttggataaatggaagaatcaggaaagactaccgtcatggaaaccaagccacgctgagctaactttccagtgctctgtagatgctgaaataggcccatcagatttggctatgtagaactcatgactgccttgaggggagtaggttggggcagtgggaaaggctgtagttggattataatggattgaggagggagcggaggataagcaggtgcagttgatggggtacacactctgaaactggctgtgacgtgatggatgtgggaggggtgagcagataattacagctacaagataatggggaaggtttcctataggtgaaagcaacgtgtgcatgttaggtaaaggctgggcagagggtgcctacgtgaccagtccccgataaaatccttggactctgagtctctcatgaattgccctggtcgacagcatttcacacttgttgtcacaactcactgctgaggggaactgagtgaatcctgtgtgacccactgggagaggactctggaagcttgtgcccgggttccctcagaaatttgccttgtgtgcttttccctttgctgattttgcttcgtatcttttcactataataaaccatagccttgagtgtgatgatgtgatgtgtcctgtgagttcttcttgtgaatcaccaagcctagggatggtcttggggacccctgacacagatgggcaggatcagaactttatgccataacaaggactttagattttctttcgagggcaaagaggagccaggaaggtttgaagcaggggagtgatatggcgagagtattgctttgcaatgggatctccagtggcagtgagaagagtgactgaagtgggcagagtggagcagggagaagaggaagtgcttacagcatcctccatgtaagaaatgatggggcctggactaggggactagctgtggagatggagacagaactgtaaaataagtagaagagatcccaaattggatgacaggtaagacttgggagagcagtgacggagagggaagtgacaatttagaaagccacatttctggtcgagtgagtggagtatgtgacccctcctggcttaggtggtggccaaagtatctctaacctgcctctatactgcctgcaactgactgagcaaatgcctggtccgtggagatcccaagctgacaagggcacctgaggcaagcctctggctttcaggtggaggccctacctaggctggcctggctggattgccctggcacactgctgttttgctgaggcagacagcagcactctgcaagtgctcttctcctgttcctcttagtggtctaaatcctgtagcatgctggggtgcgactgtagacaaatcccctttccgggccccctggggttctctatttgcagtctttgggtctggtcactggcatggcatctcagtaggctaggttcatcaggaagggtcaactatgtcatggcacctgatgggcagcatttagagtctgtgggccaggggcttaagggctgcttactgctaatagttctaagtagcaagcattccctcagccctagtctgggcacacgccaggaagaaagccactagatgtgctctcctagtggataactagcctggagttccaagaagggcagagacaggcagagtgagagccttcagagatgtaggcaacgatagtagcagaacttcgagggagagtagatggaaaaattaaaaaaaatccttgtcattatttttaaatgtctgaattgaccagattagaatctttgagagtctagacactagggagatctcatgggtgggccagttattatatcatatggagggagagtacgtatgacccagcacgagaggaccagaggacagtcagtgctaagggtaaaaccttaggccatgggagattgagtttttcatcagttggcaagttttcactttaatactccactgtttccatcatttcagacgactggggatgataaggacaatgtaatttgggggataaaggaagaactcattatatttcttggatgactttactggggaaatggattccttagtcatttgaaagaagcggtagaattccacatgtggggaatacttgttctaacaaaagcttaataacattagtggcaatgatccttttatataagggaaagcttcaagccagtgagaaaaacataaataaactagtaagaacatatttataaccatgagatttgggtgcagaataaaatcaaattggcagttcaggaaaggtcctaaacatctgtatattaacaatattccatcagtgagcaatgtgaatttcccataattgaaatgatgattgataaccttgtattgttcttatctaatataaggcaaagcagcactggggctttgataaagagcaatatctcatgtacactgaggacactgaaaccccgctaggaattctatggaatttctaaaatatttatattaaggacattttacccattatagactaatttagggaaggttctgcattttttttttgatttgacaatgtttccaatgcaatttatacaatattaaataagactaattagtttttgcacctttcttgttacaaggtgaaagaactaatcctttgagattttccagaaggtccctggcaaatcccaaagccagttttaggtataaaatatatttaagttttgattgtgggaaggcaaatgttaagagttgtcaggagttctcgaacatttgattgaatagcattatgggttagcgagaaatactacttggttagctagtgaatcagagttgtaaaaattttcaagtaaacatatgaggtaacatggttgtaaagaatcttcagttcctttaaaattgaaaagactttaaaaaaataactaaggacataataaactgaacatacagatagggcattacagtattttgataagacataaaatctttgcctcttaggcagatgactcagaagaaaaacagaccatttataactttttattagggacagaccaatgatcaagaattttttttttttttttttgagatggagtcttgctctgttgcccaggctggagtgcagtcgcgcgatcaccatgttggccaggctggtctcgaactcctgacctcaggtgaactgcccacctcagcctcccaaagtgctgggattacaggcgtgagccactgcacctagcctaagaaaattttgttattttaacagagaaaccaacattttaattttatacaagtataatatttgatattagttcttttttgaaaatcttataaatacactgaataaaagttttaaccatgacaaataaaattccttttctgtgaacattttctaattttaaagatatttgtttacattttgtctcacacatttttaaattatttgtcattttaatttgggacaaagctattctctttttccttaggaaaagcatatttgcatacaaagttgtttccctttgccatttttgccattattacttttagcagtttatatatatatatacacacacacttatttacttattataattttaaccattaataacttctctttcacagagaaaacaggaggtaggtaattttgaaatatcatataccagcattttgtagcagactagtaaagcttatgaatatacatctcataactttttatagttgttatatactttttatagtaccattttgcaatgtggacaaatgaacacatttaacagatccatatgtagtcacactgtaccataaaaaaagcaaaaagtatataaacttaaatttaggtctagtgactaagtattttatcttctttataaatgatatttaatgaatttagttaacttaattcagcataagtctaaggttttaagttaccaaaaagattttagaaactgcctttaagcttacatattataaaacataattactgttgaaataaagtttgccagaataatgactcagtttggttaaaagcaaatttaaatttttataatcttaaacatgtagtagatataatactagcttattcaacatgtaaacctgtttaagtttaggaggaacatacccaagtagagtaaaaatatatgcttgtattctgttgtattatatgtaatgctgataactcaaagacacataggtgtctattaaactaacaatattaaactagttttgtttgccaaaagtttacataaattctgtgaacttgagttttaaaagcatttgggttagtttttataagaatacttttttgttgtttacactgaaagtattagaagttgtttccttaatttatgagagctttataataatttatataagtacttatttatctctaagtcaattagaatagaggataagggattttgtaaattaatttggtaatgccatctggaggtactgaactattacacatatacaacatacatgtatactaaacatacagacagacacaaatagagatctaatggcgagccctcaatgggtgcagggggcctgaagctctactggctataggcagttgagagggctgagtgggaaggggaaagcctggtgaagagtagataggggtatgtaggaggtagaggcattgaaggggacagatgaaaagattcagggagctgaagggaaggtccaaggtggtgaaaagaagggaagagggatgcggtaggaagatgagaagggggaatcttagatgagcaggtttggggagaccccaggttccctaataaggtcactgaagttccaaattacccttcgtgattactttttttttttttttttgccagttttggaaatactggacagaatgagtgccataggggcagggcatgtagtcagcaagggaggaggaggaggatgaggaggaggaagggcacccagtagattgagagttacctgtgggaagaggcagatcaaatagagaaaggagccaggctggacagtctcattaggaagttctgcacacagtcgtcatctgggagccaaagtttctcttcagtcctcattgaggagctgaagggctttccttgtgcaatctctagacaaggtgtcaagggaaacaatgaggcctcacaaaagagccaggaatttggagtaaatctccactcaaaaggaaccaagaaaacttctatccaggacgattctggctaaaattgaaaaggaccaggaagagtcctgctcaacagagtcaggggttaaatccccactcaaaaagagctaggaagagttctgtctgcgaagattcttgctcaaacagaaaagaactgggaagagctcatttaacagaatcaaagtaactgaatcacagaaccataaaaagtgtccaataaaagcaaataccgtctctgggcagggtgcaatggctcacacctgtaatcccagcacttgagaagctgagggaggaagatcacttgagcccaagggttcgagaccagcctgggtaacatagcgagactcctatatctataaaaattttaaaaattagccaggcatggtggtgtgtgcctatagtcccagctacctgggaggctgaagtagtggaggattgcttgagcccaggagttgaggctgcagtgaactattattgcaccactgcactccagcttgggtgacagagcgagaccctgtctcaaaaacaaaaaacaaatatggatttagatagagacttttattttattttattttattatttttgagacagagcctttctctgtcacccaggctggagtgtaggtgccatctcagctcactgcaaccaccacctcccgggtttaagcaattctcccgcctcagccttctgagtagctggaattacaggcgtgcgccaccatgcccagctaatttttcaatttttaatagagatggggtttcgccatgctggccaggctggtcttgaactcctgaccccaagtgattcacccgccttggcctctcaaagtgctgggattacaggtgtgagccaccgtgcccgaccaatactttatttaaaaagactattgcaatagggacaatgctgcaacctcaggacttgcaaacatcacaaaataatacaaaaaacatcacaaaataataaaaaaaaaaaagcctttttttttcagtagggagtagtaagcacagctagcagctcagctactttcaagggccagtgggcaagcaaaggggaacctgtttggcatgatttgaccagaaatgtgtttccctgtggtcagccggttctcaggagaagctgctaagtggggcatgttctgcattgcagcacttacttaaccaggagcaagcaaaattcaggccctgtggggaggacagaagcctgcctaacattctgtcaaggcaaaggagagggtaaaaagcagacagctgtgaacacttgatcatccttcaggcaataatccattctgggtttctggcttaagactcttgagaaacaaggggaaacaactggtaggagcagcaggctcacctatatgtagttccgtgaggtagccttatggacttctgccaccttccaaaactcagcatgtcccaaaccatctttatcaacacagcttctcaccaaaaacaaccaaataaaacaaattaactaatgtactaattctgtatctccccctgtgttgttcatctcaaaaaactgttatcacctcattgactcagactctcaaccagcgaggtagaagaaatgtttgggggcatgttaaatgtaacacctatgagacatgtaagaggtgaggtgcaggacgcaggtacatggtgataaaagaaaaacctcagccggattaaatttaaaggagtttcattgagcaatgaactatttgtgaatcgggcagcccccagaatcacagcagattcacagagactccagtgcagctacatggtggaagatttatagattaaaaaaaaggtggagggggggaaatgacgtacagaaattggaagtgaggtacagaacggctggattggttacaggttgggggtatgccttatttgaacacagtttgaacactcaccagtgtatgaatggttgaagtatggccgctgggattggccaagagttagctattgttacaggtacacactcctaagttaggttttcaattttgtctgcctctaggttacagtttattgacaaagactcaaatatagaactatggagtccttctcaggccgtatttaatttgctttaacaattccccctttttggtcattttctcaactttgagagattgacaaaaaccttagttattgatatcactattacccttgtaaatgtacttatatggtcttgaaacccactgggaaacaggaggacagtgggttttgtaaggagagaataaggactgagtagaaggtacctctttatgctagaatgttctgtttacaggacaaaaacaaaacctggtctgttttaataactatttgtttccttaaagtcttagtttgattatgttacatttagcatgagcaactccattttgtttggtttggtctgttgggtcctagtgcatgagctcagtacacaacaatggcttgccagaattttgtttaaaaaattccccttggctgggcgtggtggctcatgcctgtaatcccagcacttagggaggctgaggcgggcagatcacgagctcaggagatcgagaccatcatggccaacatggtgaaaccctgtctctactaaaaatacaaaaattagccgggcgcggtggcatgcgcctgtaatcccagctactcgggaggctgaggcaagagaatcacttgaacctggcagtcagaggttgcagtgagccaagatcacgccactgcactccagcctggtgacagagcgagactccacctaaaaaaaaaaaaaaaaaatatttccccttattggccaggttctcacttaggtgagagtgtgaccaaaacttagggccttagcaccacttttagttacctagttaccatcattttaggtttccagtctcagcatgtcattcataggttatgatgtcctcataatcatacatttcaatcagttttgttattccagttgaagagagaccatttgacatttcagagatggctgcatgcaaacatttgaaacctttgagagaatacagtgcactggggagactactatgactaccagtaggataatacccagagtttgaagtatgctgtttacctgaggtccccataaaacaaactgcctaaattaaataaaataaagaatgagctagacgaagagtctactcacttcactaagtgatcttttcattaatcctgtatgactgaatttttataatctgcacttgatatacatattagaattttagaaaccccatataattttggaatatatattaatataattcactaaaaatataccctgaagattaaacattatttttattggccaagcgcggtggcttacacctgtaatcccagcactctcggaggccgaggcaggcggataacctgaggtcaggagttcaagagcagcctggccaacatggtgaaaccctgtctccactaaaaatagaaaaattagccaggcatggtggcatgcacctgtaatcccagctactcgggaggctaagactggagaatcgcctgaacccaggaggtggaggttgcagtgagcagagatcatgccattgcactccagcctgggcaacgagggcaaaactcagtctcaaaacaaaacaaaacagtatttttattttgacaatgcctcccatgatttttataccaaataagccaaatgtcactgttgcattagtgcattatcgatgtcaaacccaattcttaaataaaaccttatagacaaatgtattcaatcttaatcagtttgaacataaggtaagaattttataaaccttttataaccctttacaatttttgttgaagagcagattagtgctctaagaaaacctgttgtgcttttatgtccatgttcaatttatggaaaaacctaataatacccttttaaatttagtattatcatacataaaattttttacaaggttaattttttttttttttttgagacggagtcttgttctgtcgcctaggctgacagtggcatgatctcggctcactgcaacctctgtctccccagttcaagcagttctcctgcctcagcctctggagcagctgggactacaggcgtgtgccaccatgtctggctatttttttttttttgtatgttagtagagagggggtttcatcatgttggccaggctggtctcgaactcccaggtgctcaaaggaaaatttaagacagtccatggaggagaaaggtatagacaaggtcatgcagatattaaaccagaaaggacttatttcctaagccaggaatcgaacccagactgccactgtgaaagggcaaaaccttaactactgagcccagaaggagtctagagtagttaattttgagcttgcaaaggcttttaactagtcaagataatttttagaactaactatgatatgaaccctaaaattcctgttccctggaaggtagagacaaggagaaagtactgccacatggttacaaggtcaagctcccaaggacataaaacaggatggcgaccttgtccagttttttgttggtttcagggacctgcagcaaagtttgtcactgaccagcttgctgggccatcttgagcagcaagcttatgggggcccaagcccatgttttatcctaaggtacccctcgacacagaaaaacgactttatagcacaaaatataccagattgactacagcttaagactagacagcctcagaattcctttttgcattaattaaaattttacagaggagataaacagtgattttacaatcagtttgcacagagagagagaagcctgaaatctgactgggaagagatatttacccttttgctggcatgccaggcttctgggctccctttccctgagtggccctggtgatctggctctctgcaccattgccccgggagccaagccacaacacaaaagaatttttttttaaaatgcacttcagtgtgttgttgttcatttggaatgttccactgtaagttatctttcgtaagatgtcaccatttctgtaagaatttgctgcctcccgggcgtaatgtgtaacccagaaggaactcagttttccagaagcaattaataggttccatggaatgttgatggtaagaaaggaaggaaaaggtgacaagagtgagcgtagacagctctttctaaggagtttggctgctggaaggggaagagaagcagctggggttaggtgggaggaactaagtttagagacgctaaaagtgtatgtagcaggagtcacctgatcaggttgaactgcagcaggaacaaggaagttccattttgactactattagttgcaaattggacccttatgtcaactttttcatctgtaaaaaaaaagggatggccaggcacggtggctcacgcctgtaatcccagcagtttgagaggccgaggcgggcggattgcctgagttcaggagttcacaaccagcctggccaacaaggtgaagccccgtctctactaaaatacaaagaattagccacgcgtggcagcgggcgcctgtagtcccagaatctctggaacccgggaggcggaggttgcagtgagtcgagatcacaccactgcactccagcctgggcgacagaccgaaactccgtctcaaaaaaaaaaaaaggggggcaggggatgaaaatgctattgctttccaggaatagctatgactacttccaataaagaagacaagaaggttccacatgtgaaaactacgcggtcacaacgataagtgggcgggtgcacgcacgcgcgctgagatcgtgcgtgcacaggccggggtgcggccggcgtgagtacgcctgcgcgtgccgccatttcctgcagccgcagactctgcctgcggtgctcgccgggaaatgagacgatcaacaaagaaaatggttgttttgggcgagatcgaccgtggagaggctttttctgcagcagtcccggttcctgccgccagatggcgctcgaggatcacaaatgggtctagggttctcataatggccccgcctaagaaattttggattctcctggcccttcccccctttgtggggtcaacagcggatttgggaatctggtgaccaacacgtgcgcactcccctacccttgcccctaccgagccctccagggtagcttgggggagaagctcctccctagactgccgggtatttgatgagcctggccagcgcacaggtcttgagcaccatggtcagggaagaaggctgaatggcttaggtcttcctagagaggccggaggcgggaaagaactggagaaaggagagatggcagtgggaggatggggacaagaataccagtgtgtttccagccagaagacgatgtcttttaacacctcattgaagtcgtcaggtgactttgcccttgtcagaaaggagcagcactgcgggggtcctactgaggaggagactgactgctccttggggtggggattgtgcctccttcctgtctgccccactcttggggagatgagtccctccaagtccacgagacatgacagccagcctacctgccatgggagaacaaagtctagtctcagggcactcacttcataagggtcttattcttcctcagcgtgttgactgattttgaggggaaggatgtggccaccaaggtcggagaggcctggcaggacaggcctggagccccaagaggtggccaaggagacccagctgtacccactcagcaacctgcagatcccagtaccccagaacagcagaacagccccagcggatctgagcaattcgtcagacgagagagctgcaccagcaggtacgagccaaactgcactgggaccttacctgctagagccagtgtttttgtccagggcagcaacccaggacaaacccccacacactaggcatgcctgtttatcctctgcaggtgagtgtggttaggagccagagggaaggagagaaaccagcatctcaggggtagatattcatgggtttcagcttggagccatagcatcaaatctgttagactaagtctggcacagaaaggatgcacagagaaccaggttgtctggcagccagttcgaacctggaaacctgggtcaggggagggatataggttgctttttctgttaatggagatggaaactctctgagcaaggtgtgccatggtgtggatgtgattcactgccagaaataacaactgtaccagttggatgagctcttccactgccatcagcactgggatggccatggatttggacagtaatgtagctccacagtgctgactcagggttgctcattgattgcaagaagttggcagcagtagcctgaggaaacaggggctctgaattttctgagagagaccaagaaccaaggaacagccaggtactagggaacagacaacaccagatgcttgtgcttttctgtgagcagctcaggtctcccaaagtggtagtttcctggcttctggcctttgtagatcagtgtggatccacacccaattgtgatgtttgtggtagctgtaagaactttcccaattttgaaatcctaggtgacttgtagcatattttttcacatttgaaaataattgagttttgaaaatgtttttacaggcaatctagtatcagattttatatcatcctgaaacattctgtcaattgtcatttccaaaaatccatggaaaactggagttgttgaactggaaacagtgtggtctcaggaagtgcttcacagccattgcaacatgggcagggcctagagggcaggagagaatgccatgatttgatgacattttacccattcctgccaggtgaacttcatctccctctctgtgacagaattttctggctctcacatccagctttggtcactgggaacccacctattggctcttgcactggcaggacatgtggtagaggcttccagttcgaggcaggactggctgcattttcaagatgtccttatttctggtattttgtggcgatcgtcctgtccacttaactgattttgacccattgccttgctgtgatctctgtgctctctctgtctcccagttccaggtcattcccttgaccagcttccagtctttcctcatcttgtccctgccaatgaagtattctggctctgccttcactctcctgccatgatccattgctttgatagggtggcttcaggaacagggtgaggagagggctgtgctagctttatcttgccaaggaactcagcaaagaaaatttttgctgacctcttgcattcctcagcctggctctggtctctcaaacctaacacatgggatgcatgccagcagccagcctcagtttccctctggtccttttctgtgtgaggccagaggtccttgctttatcactgcctggagctgcagttgatgatggtgaaagaaggtgcacgtgtcttttgagagctccctttgttccccagagatttttttttcccaaagtggccatgagtttgggaataaccaggagccatgggccgccggctagagatgctgcatactaagagcctcctgtgagcagccatgtacacagtgaacacgatggctaaggccccatccagccgccctcaaagagcacatagtccactaaggaataagcatgatcgtaataaccattagcacctgctgtgtgctgagaatgtgcaggcactgttctgcatgccttatgtggactcactcatttaattctcacaccaactcaaggaggtgcttttattatggagaaactgaggcagatggaggttaagtaatttgctggcagttttgcagccaggaagtggcctaaccgagattagaatccagacagagatcagagcctgtactgttcatcgctgtggcatccatactgcccctccatttgtgataagcccaggaaggaaagaaaccaggtgctctgatggagaggggttagagcaaggatggttagggaaagcttttctatcgaggaggagacagttcggctgagacctgaaacatctggaggagcctgccttccaaagaacctggggagaggcattgtggacaaagaagatagggaggagggcctgaacaatgagccctgtgcttggagggtacggggtgaggtgagcagggggcaggagctgggccctgtagggtcttgtaggtgagggagaggaggctattgggagggctcctattgctcacattgcagtcctggggggatgcccagggcattttttcttttttttaagaggcggtgtttcactgtgttacccaggttgtttttgaattcctggcctcaagtgatcttcctgcctcagcttcccaagtagctccagggaatttctgttttaccttgcctcttcagttgcgccgtccccttcagtattctgctgacatggatcacaggataccagacacctggtagttgttcagtcagtaggaggtcttccttccttcctcttagaatcaatccttttctcacttgttggctctgcattttatcccccgtgtatcttttcagatttttgtggggcctcctctcccatccagtccaccttctccagtctctatggtatatttctttgtcatagggtgaagcaggaacaggtacaggatgattgggtacactgaggtgaggtaggagggcaggccctcaggaagggcttcccagaggaggtgatattgtctgcaaaggcatatgagagcctggaagtccaggggaactgcaggctggtctgtacggcttgagtggcacgtgatacagtttgagactatgaggcgagagagctaggcagatgctagaccatgattgttcttccctttccccactcttcaactagttgtaatcttaggcattggattctctggcaaggggacaatacccagtagcctgggccagatggaggcagccatatctggagtatgatctgagccacagcatgttggagaaaagccagaatcagcccagggcagtgtgcacccatagtgctggcctcaggcctttggagggtgagcagacttaagttggaaggtgcaaacaagtggtcagtggtgctgcccaacatcgtgccctgaactgcagttgacagctacggcagctttggtaatgaggctcatagcctgggggcaggcagagtgagagccgatattggcttggccagagaaaagcccttttgggctgccgaggaggttggattccaggccaagggccatatctggcagctgaagtgtggaggttcagaaaaacttcgacaccggtcagtttcccgcctctgctgggaatgaggtgcatctgactttcctcctcaatgatgcctaatttcatttggtcctctgccccttggccttgtgttctctagagagttccctgcagggtggcagaaggagctgatcctagtaagggaccgtcccatccagtgaggaggtgagctgggctgtgtcttccccttctgcaccctcctgactgtcacatccccgggagccccatgattccactctaactgagtgaatcacagaggccaaggcccttggctgcagtcaggagtactgagtggacactggaagattggggtcttgctactgactcacgatgtgacctgggacatgtctcaactcacctagcctgggtttgcttatctgtaaagtgagaagttccatttgttggtcttggaggaagcttcaagagcagtgctcaagggttaggctcagaaaagcctgtttgaccctggaaggtgtcagctcccaggttgacgtgcccacccctccctttatttctttcagggtgaggagcccctcgagctgcatggtcactgttactgtcactgccacatctgagcagcctcacatttatattccagcccccgcaagtgaattggactccagctctaccacgtaagaagggctatctagcaacctgggagatgttcctccgccacttcctccttggcggtaaaggacttggcttttgttccatgttgcttcccatttagtgccttccccagtttctagcaggccattagccaaggggccacacaggacagtgttagtcccctaatataaactcccatctaccgggcctagacattcccacacctcctttttcctatctctgtaagaggctgcagtggtacttcctagtgcactagtggatgtggctctgccattcatgggtccatgcctgggaagccagctccagtccgtgaaggccgggcctgtgagggcattcctgtgttactgtaaaggaatacctgaggctgggacatttataaaggaaagaggtttaattggctcacagtttggcaggctgcacaagcatggcaccagcagctgcttggcttctggcaaaggcctcgggaagcttataatcatggtggaagccgaagtgggagcaggaccatcacatggcacgagcaggaacaagagtgaggaaggggagggcccggactttgaaacaaccagatcttgtgtgaactaactgaatgagaactcacttttcactaaggggatggtgctagctgttcatgagggatccccccatgatcccgtcacctccctccaagccccacctccaacactgggaatcacatttcaacatgaggtttgtctgtctctgtcacatgcccactgcttcacctgcattcctggccacctgtcagggtgcaggaagggatgtcactgcaggaaggctgctcagtgaggtgtgtgtgttgggggcgggaggggggcatatccaagggggcctctgcagacatcaggtcagcaggctggagtgtgcagcatggaaatgggggaaaatttggggccatcctgagcccagcatgatgcagaccttgtttccagtcctgcagaggccagtccaggatgaggcaacctctaggcctctggactctaggagtgagaatggagaggttagatgtgaggtggagattgcacagtagctgagtaccttctgggaagtgctgagtggtaaagactgacagtgtaggattaaggcttggaggatatcttggttgtgggtagaggggaaagacgacgcagccctaaagtaggggtggaaagcccacaggactgaagtgtagaagtatagaagcctggggagaagatggggtcaccgaggtctgcatggaggaggacagcacattgtcattggttgcaggaagcccctttctggggccctcagtccaaacacaacaagagacgctcatggcctgggattgtagtctgagtccacagcagtgccagtgcctttatcctgggccttcccatgagctctttcacttccttcaaaccaggctgggtctccccagccctgaaccactcctgtgggccaggcctggttccctggaatcttctggtgtacctctgatttcttctgtgctccttctacagcaaagggattctcttcgtgaaggagtacgtgaatgctagtgaagtgtcttctgggaagccagtatctgcacgctatagcaagtaagagcgggtcccaaacccttccatgtcggccttctcctgccggctcccatattctcatccctgcatttccagttccttgtccaggacttggctcagagtagcttcggggtaattgtcgagtggatgagtgatgtagttgccctctgatgggattgatgcattttctactgaactgggcacctttgggttctcccttccggtgaattcatcctgcacaccattttcactgccattctgttctgcttgtctttgttattttattttgtaaaatgctgagaacacccctcttgacagagctggcagagccctagggaccaactagctcatcctatttcttttcagatcacagagctcttctcttctgccctcatgttcttttctgtcatgccaggctgcctcatttgaacacacatgtgactgcagttcctgatacatgtgtggctttgctttttaattttaattaattagttaattaattttaattaatttttttttgagatggagtcttgctctgttgcccaggctggagtgcagtggcgccatctcagctcaccacaacctctgcctcctgggttcaggcaattctcctgccttagcctccctagtagctgggattacaggcgcccaccaccatgcccagctagtttttgtattttagtagagatgaagtttcaccatgttggccaggctggtctcgaattcctgacctcaagcaatccacctgcctcggcctccccttttcattgatcatctcttcattttcttgctttgtgatgccatgtggaggggtacttccatgtcacctcggtgtattgctacctaccacactgaggtgaggtcccttagaatgtttcttatgacatgtcatctcactggaggattttagcaacagagaggagcatcctggccttatttcaggattgggcctctggggcttctggactggcttttattggtgctgtggaatgatgagcatggctgtgggggtcaagttcaagccccagctcaggcccccctgttaggatcacttcggacaagatgttcaacctctctgagctttgctttcacatctgtaggcccttagggtggtttttctcaacagcttattgagttataattcaccctttaaagtgtacagtcccgaggttttggtacattcacagagttatgcaaacatcattatccaattctggaacacctttgtctccccaaaaagaaactccaaacccgtctgcaccccctaattctaccccataactcaagcacaggtattataccagaatgatcccttctttcttctcattcccagtatctgatttctgctgagtgggctcctggtgactgtcacattatatcataggtggggaggaaagctctgctgttttcccactggtcagtggggtccccttggcatatacaacctcaggaatcctagccacccagccccgatcatctccctcattgtgaaaggtctcctttgcccccccatagaagggccctgtggcaccaagtcatgaatgacgactggcatcgtagttatgtctcagcttgtggccaaaggttaattagaaaattaactatgatagtgatttggctctcatctctgccctcctctcccctatcaaactccctgcagcgtcagcagcattgaggactcattcgccatggagaagaagcctccatgtggcagcactccatactctgagaggtatgttgactttcttagcacggagcttgcacttctacagaggagaatcagggaagggagagttcctgctgagtctgtttgcttttgtcttctgctttgcagcctccaatccatttgcagaaaggtgaaggacactaccgtagggtggtgcttcccttgttgggatatcacacttgtgacaactaaagcctttgaattgagctaagactagagggtagataccagcggtgactgagaagggaagtggtggcatctgacaacccagaggactcgtgtcagcaggaggggcccttcagattagaacctaatcaatcacttcattaacttgcaaatctaaccagaagtaaaaataaaatgactacaaaagagaggagtgggcagagaaggaagaaaaatgggctgctggcatcaagaagccagaaagacacacaaagccaagaatgcccagtgctgtggagccaccaaattgaaagcaggggcagagaacacctcgttcagcagttttgaaagctgtcactagatgatggcacagtcactagagagtcttaatgacaaagaaatcttatgttcagattcttggaatggggagaagagagtctcagagattgagttcactcaggcttctgtgaagaaaatggaataaatagccttcagtccacagtaagcaaatacggcagacccaggactaaaccccagggccctgactactcccaggttagggatgtttctactctgccatcttgcttctcattgatgggcagatcttaattcatgtggatgacattcagagaccaaagctacattggggaggaaaaggaaggaagtaagagggttaagataaagagaatcctaccgggccccagaggcaaacatataggagcagacaagcatatggggccagggaatctcctccactatagctgaagaagcaggtggttctgagtaactacagattacttggtgaggcacatcagcagatgaagtcttagcagagaagggcaggttggtcagaaacctgagagttaaccacttacataggagcaaatggaatgaggcttccaattctagtggagtgacaaaccagatactctagggacccccctttccattgcacaactactaaatccagaatcagtcattactgatccattgctaggcttggaggaaggaaggggactctctagggacaatctcagtcacttgcacacatgcatatgcacagacacacatgcacgcacacaaagaacagctgtgagctggtgctgctggtggtgaaagaagcaggaggagcagggctgcgctgagggcaaggatttcaagcagcactgctgtccagagtgaaccctgggccagcagcaggatggtgggccacacccaagctgcccgtgacacttctgggtcctccgacagagctaacgtggatctagattgttaatgtccccccgccccttgggcttctgtcagaagcagacccaaatctctggaagaaagtaccctgaattttggcttgtaggatcagatcaagcagttactttgaggaagtgcagtctgaggaagaaaagcagaggtgactctcagaaacaggcatcctggaactggaaagatgctcaacccaggagtcagtatctagaacttcagtgtcggatctgagtaggctctacagacagagcatgaagggtgggtccaggagtataggcaggggcagagctcagttggcccaggcgtgaggagaagggccatcaagacggggccaggcagggcacacaatgacatgtctcctgtaggagaaggcattggtcttcctgctctagagggtagcaggccccagcggataatctaagcagaaggtcagggggaggcaaactgtctggaataagtatcatatcaggacatctacaggagacatgtcattgtgagctggaaaaagatgcatgactagtttttggaaataatgcagaggtctacagcaggctgagaactgatctggcccagggctgtgctgcacaccacagaaaacagtggcatcctggggatcctgacagcaaacctgggcctggctgcaccaaattggaaggtctggctgtgtcacatcagaggtctgtacaccagcctgaccaccgggttattgttcttcatctcacaggacaactggagggatctgtacttactgcaaccgtgagatccgagactgtccaaagattaccctagaacatcttggtatctgctgccatgaatattgctttaaggtaaaaaagaggtggaagacaccttgagctaggcggtaactcctgatcacgtgctgctaagaacgttttgtagagtgcgggagtcttacgggttcagagactgtggaggaggcttgatctccatatacaattgcacatagtcgcagaggctttgcacaactgggagctgaatgagcttccaagtctaagacagtagatgagtgttggtggttctgcatgcttagtactgtagggaagacaaaagaggtcttttcaggaaagactatttctggcagagggccagcaagtgcaaaagccctggggcagaagcactagagtgttctagcttgcgtgggagaatgccaggagtgacagagtgggctagatcatgtaggccttggcgggcacagagtttggattttattctaagtgacattggggtccccattctccacagtgtgtggcactttgtaaccccaggttgttggttccaatccatttagggtgtcacctctgggtgcactgagaaaaacaaccctcccctttgccttgacagaatgttaggcaggcttctgtcctccccacagggcctgaactttgcttgctcctggttaagtaagtgctgcaatgcagaacatgccccacttagcagcttctcctgagaaccggctgaccacagggaaacacatttctggtcaaatcatgccaaacaggttcccctttgcttgcccactggcccttgaaagtagctgagctgctagctgtgcttactactccctactgaaaaaaaaggcttttttttgtattattttgtgatgttttttgtattattttgtgatgtttgcaagtcctgaggtccaggatgtgccacgggctcacagcatctgctcgcccaccttgttcaggcatccccttcccactccactcattcctcttgctttgctttgtgtgttgacctccagcttgcttttcttttcagtgtgggatttgcagtaaaccgatgggcgatctcctggatcagatcttcattcaccgtgacaccattcactgtgggaaatgctatgagaagctcttctaggtgggtgctggcactgcaaaggacaagtggccaagagactcattaaggagtagagatgcaccctggtctctcctggagtctcagccccagacacagctatctttcttggctcttccttatgttcagggggccttgtgtcctcatgtccctatgccttgtgatactttgagatcttaggtggcatggacaaaggccctcaatgaggacacttccaaatcacaccttccgtccagcacctgagccgagccctctagctaccctgggatactcgctcggccgctgttgttagccccattttgcaacaaggaaataaagatatagaaagggaggggacctggagaaacccaggtagaatcaggacctcaccccaggtctttggattcttgtccagggctctctgttcactgtcactcgcatagcttcagatcaggactgcatagccatggtgctcagtgaaacaagcctctgggccacattatgagaactgcctgaagatgtgtgtttgcatgctcatagccagtggaatttatcacggtgtctgagcacagagcagaatatatcccttgaaggcagtagcaaccaggctttccactagctccatgctgatggtcttctctccagaagacacaccttgagctaggtggtaactcctgatgactggagcagtcacccaccctgagggcctctagctgatgtgtttccagtctcatggctacttctgttttcttttagcgaccccccaccgccaggctgatcagaagctgatgactcgtggacaaatttggctgtccccagttttgccccaagttgctgtctccccttccctcacctcctccctccctgtttgatttcttcatgcttttgcccttctcaagttgaagttgcatacatccaatatcgtatcttaatgatgctatgataattgcttgtgtgtgtagcttcttgtagcttagaaagcgctttatgcccatgatgtcatttcaggctcaaccaaagaggatcaaacaggaattccatcttggcttccctaagacagattggctttctaatgagtttaagtgggcagaagtgtagggttcagtgtgtcctgactcccttgaggcttataatgggccaagttgaagactgttgatgatccctggtgggtaaattgcagacatcaaatgctagggattggcataggctagtgtttagcttgtctatttgccatatctattttttttaaatttccatacacttgtaaaagtagttagttgcttttgattgagttatatagcagtttttcatttggtcttccactcacctttcactatatttgagtgttcccttacaggtatgttggcatgtgttggaaaatttacacaattaggtttaaattcagtaggatgtgattttaggatgctactgatcaaagtgatatctgtgtctgttggaatcttgatagctgattaatttgccctcaattctgctccctgaacttcacacataaatcttcccaagtgggttttagggtgtatagatcccagcaggattaaggaggtggaaaagcagctaacatttcttgaggctctaccacatagcaggcactgtcacagagtaatggcattaatccccataataatcctgtgaaggtgatattctcatcccatcttagacatgaggatattggaactcagagaggtggctattgcattgcgcagaacgctacagagcccatgctcttcccagagcagcacccacaaaagcaagcattgattttgtgctcagtgtgtgccaagcactgtgcagagggtacacagttcctgccaggttaacaccctcccttcaggcctcccaaaggcataggcttgcaaagagcagaaggtgtgaaatcacactcttcctctgggcatcctggatccctgaattatccccccccccatgaagtacttcaagggccaagctgcccctttccctcctctccgcccatgaaaatgcctccaaactgagatgctttcagctgagaacagatttgactcacagacattaccaaagaggagcttgtgaatccaggaaaagctccagggggctagctgatctgagcagagagctttcagtgacccattttcctgtctagactctgccttaagctagtggcaactgctggggccccaggtacttgggacatggaaactcgttggatggctgggcagatgtaagcctgtccatgcagtcagccgatcctctgctcaggttcagctggactctgccatctgtgggcccagcatcactctgtaagttccttgaaaggaagaacaaccttagagtatttctgatacaaaatgagggcctctgctcttgatttaattataaaatgtctacgtctttctccagtttctgagccctatgcacattggcttgtgggcttgttcttcctgccaaatgatcagagaggaacattccatttatttgtagtggatttcctctggagggcatgtacccacactaaataccaactgctcttcctcagctgtagtccccaacatcagacttggcacgtggtggacactaacacacaggcactcaatgaatgagtgaaggaaataaaagtcaccccgttggtgagaggtgctatccctgagtctcagtgcaggaccagtggatgaaaggcaaggtaaagaggcccaagataggctggcttcccccgttcaaggtatagtctgcctttaagggagttttagaaccaacatgcaagacattgaaagaaatcttgcaagagccattattgacttagatccaaaacagcctctctcatgtctaaaaaggcacagaattttgcagatctgaggaagagggatgcattacctttttgcttcttttcaattgcttagtgtttctaatcatacttaatccacactaatgtgcgcaattataataaatggtaagatatcacatgtgtca

SEQ ID NO: 175 - DNA, 59041 bp, Homo sapiens; identical to SEQ ID NO: 174

SEQ ID NO: 176 - DNA, 59041 bp, Homo sapiens; identical to SEQ ID NO: 174

SEQ ID NO: 177 - DNA, 59041 bp, Homo sapiens; identical to SEQ ID NO: 174

SEQ ID NO: 178 - DNA, 59041 bp, Homo sapiens; identical to SEQ ID NO: 174

SEQ ID NO: 179 - DNA, 55618 bp, Homo sapiens
tgttccctgaagctcggtggggtttgcctacacagctgctctgagtggcgcagttccgggtgtctgtcagggccaaaagcaaagaggaaaggctcccaggcagctcctggtccacctctcatgtgtccactgggctgtgtggccaaatctggaggcaggagggagcctgcaggtagacacatggaaccttctcctctctagtgctgccagtctggtgagaacagctaacgctggtcctccccgcccctcctcctctggctacaagatgaccactgaggattacaagaagctgtgagtatgcaacgccaggctcagcgtggttccctcctccaaggaacaagtccaaactctgggtccactgaaggcagctgactacttgccaccgagcacagcccgggaagtcccgcctgcctgacactccctgccagttgcagctgtggcctggagcccaccagagggtaacaagccccagaaaactggatggctgtgcacattgcacgtctgatccgaggcagagcggagaccgcaggaagcttgtaggaggggccccacggatctggggaaagggtcatgggtcgtgaggctgctgctggctggctgtgcttcctgggcttggccctgcacccggccgagcctcaggtgctctgcctggctgcactgggctgggggcctggggatcctcagggtgctgctgtcagtctgagcattgtgtgcctaaatctgagctgcttcttggatagaaaccttcgggttttcccttagtgctccccttggggtccctttcaaagccccccaccccccactgcatgctcagggaggagggttctctggacagaggtgtgaattgtgtctctagttcccaggggaccacatctttccgttgtttgtcccttgcctccatcatccagggttggggagctgctgggtaacctttctggggaaggggagaggctcgaacagggagggaggggagagctggtctcagggaggaacaagtggcatgacctaaggcccaaaggcagagatattgacttgcctcgtcattgttgttgaaagccaggaagccaagctgctgagggtggcagcctatgacaggaaagcgcctctcccctctcttagggcaccctacaatatcaggcgcagctctacatcaggggacaccgaggaggaggaggaggaggaggtggtgccattctcctcagatgaacagaaacggaggtaatggaatggtgccttttgggcatcccggggggcagggcaggagcctgagtcttcgaagactgctggaatgaattgtactggttggggtgacaaaatgcacaacacgtaggccatcagcggtagcccacggagcatgagaataggtgtcattctctgagtgccagaaccacccactcagtgttggaccagctgaggggcccttgagaaccttctgtggggtagaacctaggtaatgtgggtccggggaaaagcctcctcatgtggaggctcttcagggctctaaatcggtttgttagaaagggccctgagacagttgaacaaaaatattcagggagaagccacctgcacagtgccctctatctgcatgatctgcatgccttgggggttctgaatgccccggaccccaaactgagctccaggcatgcacagcagtgggagtgtgccccatgctgctgaaattctaccctagtctctgcgccaagctgccctcgtccacacaggccagcaaagttccatggacccttgcccctcctcagtcctctgtccatggggactgaccacataccacccagtgctggtgaactatgacaggaagggtttgttaagcaccttttgtatgcctttggcttggggcctgtacagcagttgggccctgaggaaataaagccctcccctccctgggctcagccagccaccaggtccatatctgctgacccatctgtggcgcaggaatcacagcaaagccccattgccaaaggccctggcagattggctatcctcagggaacagttcacagtggcaggggcccccaggcctgggtggagcaaggaaaagagccagaagctaggagctgcctagcattgaatgccagctctgccacctgctaggtgagtgctcttgggcaaataatgaaagcttcttggactcagtttcctcatctgtaaatcacagaggatactagcgtctactttcctggattgagaagagcaataagccaatgcgaggatgttggcatctggcgcagagccgggcacatgccacatgctccataaacatgggctgcccttccttcaggttctacatttcctttgaatagtccttggagcaggtgcaaatctggtttctctcaccccttgcctccctggggtggccctaagtcaccccgagtccatcccaggctaggctggcagagcatgtccagcttggcacccatcagatgctcccccatcccgtgtcaccccaggtcagaggctgcaagcggtgttctgaggaggacagctccccgggagcactcctacgtcctgtcagcggccaagaagagcactgggtgagttgccaccaactggctccaggctctaggacagctctcctctcctcagagctccagccttctctggctgatgaaagggtgggtggagagatcacccccaagggccttcctagctgagccttctcagattctcagatgtactttctagaaaatggagaggtctggcggctaccaccagggacagtgaagtgccgggaatggagagggcccaggaccctctgaggtagagcggtcttgatgtcacctgcccacgggctctgcccaaagcattgcctttctgcttcctttccagcagtcctacccaggagacacaggcaccgtttatcgcgaagaggtaagtgtcatcaagggacaccttggaggcctgttactggccacaggaaggccttccgtcagcaggggtgtagtgtgggagctgtggagaggggatgtggatgtgggggactactgtccctgagcagggggagttgtgaggggctgggggcttctgtctggaggcctggcaagcacctgggtggctgtggtagcatatgtggtcaagctcttccatttgccaatggctaatggggctgggcccctgacccaacgtggagcatttccaaggccctctgggagttgttcccctgcccctgttgcttgcctgatgccttgccttctgctctcatccaggatcaaaacctgggccatcaggagaacttcccctgggaggtgactgtgacattggagatgggccctaaagggtgaacagggcttaacagggaatgatcagaacgtcgggatactccagctgaatgagggaggggtgtcaccattagttgagacagggcaccttctggaggaggaaaatattcgggggaaagcaagaaagaaacttctggaaacttgaatttgagggacttccagttgagtggacagggaaggcctctctctgtgctgaggtggctagctggggactgcaaacccaagagaagacagcatgccaactgccccaggcagagggccccagtgcacaggcccggggtgggactagcttgctgtgttggaagaccaggaagttggcaggaatacagagagcagggatggtggcagcacaaaggaagtgacagagaacggggggcggtgggggggtcttcctggctgcatttggttcctgtggtttctgtaacgcagtaccaaaaactgagtggcttaaaacatcagaaagggattctctcccggttctggagaccagaagtctagatcaaggtgttagcagggtgggttccttctggaggctttgagggagaaaccatcccaggccactctcctggcttctgctggtggttggtgatccttggtgttcctcggcttgtacctgcatcactccagtctgtgcgtctgtcttcacatggccttctcttctctgtgtgtctgtgtccagatttccctcttcttacaaggacagcggtcattggatttaggacccatcctactccagtatgacctcatcttacctgattacatctgcaaagaccctatttccaaataaggttacagtcacaggttccaggggacatgaattttggggggacactattcaacccagtatgctgtccttatcctgagctggagtcactgaacccccagcctgggccacctcttggccgtgatcctgaagggttgggtcagttagacgccactggaagcatgttctttgaggcctccaagctctagggcagccaagaagaccacgagcgctgtttctcttcttgctcaaagggtggaggtggtggaagaggacgggccttctgagaagagccaggacccacctgctctggcaagatccactcctggctcaaacaggtaatccattgcgctcatctctgcctggggctggtggctgccatacctgccactcagtcactgaggaacctcagtcagggcacctccatgctgggcttcgagatcagtgtccccatgtgcccagtgacaagacgggacaaagaaatcagtaagagcccatctggctggatgtcccagggctgaaaggagcaaaacagtccagccccccgggagagagcacctggctctggtctgatgagtacgtatctgtgtcaccttaacccttgcaccactgagcctggtggcaacttgaacaccccaagaaaaagtaccatccttggggtttgagagggccagccaccatggcagtagcatgccattgtcagacttgctccttgcactccaataagttagccacattcagcatgcccagggaggaggctctgacatctccagagcctctcacagccaccttctttgccagtgcggatggaggcaggaccaaagcgtctcgggcaatttggatcgagtgcctgccaagtatgcctagccccgctgggagccaggagctcaggtgggtgccgagagctgactctggcttgtgagtgggtgtgatggcttcccgccagcctggctggctggttctgccagctggggagggtctggcagtggggtgatggggcaaggacaggctgagcactggtgatctcactccaggaagggccgtgatttgtcttgatttctgatccctgagaatctgggcagataatggtgctctcttgtctgtggacaactaataccttcttgtactttgtgcagaatggtgctaagtcctgcagggagagccaccacctgctgttgctgctgtttaaagtgcctgcctggattgagacctttgctcaaatctaggtctcctaagagctgcatctctgtagcacccttggaagacccctgcatccagaaggggagagggcctgtccctaccggtcacttcccaggcccccaagggctgttcaggctctcctaataccatagcaatcccccaatttgagctccacagccatttatagacaggtgaccactgtcctcagggttacttcctcagtctgggagggagacagaaatgctggcagagggagccaggagcatgaggccagctccctccatggccccaggcagcagactgccagggtgcttctccttttcactctctccctctcttgatcttctctggttgtctgactctccccataagaactttggtccatagaagatgtggaaaggaagatttgagaattctttacaaggcaatatctagggcagagctccccagtctttttggcaccagggattggtttcgtgaaagacactttttccacgggacggagcaggggatggtttcaggatgaaactgttccaccttagatcatcaagcaccggattctcataaggagcgcacaatctagatctctcacatgtgcagttcacaatacggttcgcgctctcatgagaatctgctgatctgacaggaggcggagctaaggcagtaatgatctctagcttacctcctactgtgcagcctgattcccagcagaccacagactggtactgatcctcaggctggggttggggacccctgatctaggggacttggcaattgagggatatgggggcaaaggctgccacaacaaagtattgtaccacaccctggggcgcttaaaccacagaaacgtatcatctcccacttctggaggctagaagtgtgagatcaaggtgacggcaaggttggttcctcttgagtctctctccttggctggtagactccatcttctccctgggcccttatatgctcatccctgtctgtgtgtgcctgcgtcctaatcacttctgtttttttgagacagagtctcactccgtcgcccaggctggagtgcagtggcacagtcaccactcactgcagcctcgaccttccaggctcaagagagcctccagccttagcctcctgagtagctggggctacagtcacaggccaccatacccagctagttttttttttttaaatttttgtagagacagggtttcaccatgttgcccaggctggtctggaactctaggactcaaatgatcctcctgccttagcctcccaaagtgctgggattgcaggcatgagccaccgcgcccagaccctaatcacttcttataaggacattggtccaactggattagggcccaccctaacaactgtattttaacttagtcacttctttaaaggccccatctccaaatgcagtaacattctgaggtcatgggggagttaagacctcaacatatgaattttgggtggcacaagtcagcccataacagtatacagttctcatttctccttatttctcttttaaagaaaggcaataaatggtttcaggtgcctttctgtttgttcgtttgtttgttttgtttgtttttgagatggagtctcgctctgtcgcccaggctctgtcgagtacagtggtgtgatctcggctcaccgcagcctccgcctcccgggttcaagcgattcttctgcctcagcctcccgagtagctgggattacaggtgcacgcgaccacgcccggctaatttttgtatttttagtagagacgggtttcaccatattggccaggctggtctcaaactgctgaccttgtgatctgcccacctcaggctcccaaagtgctgggattacaggcgtgagccaccgcgcttggcctcaggtgccttttagaagataatataggaggctgggcatggtggctcatgcccgtaatcccagcactttgggaggccaaggcaggaggatggcttgaagccaggagtttgagaccaacctaggtaacatagcaagaccccatctctacaaaaaaataaaaaataaaaattaaaaattagttgggagcattgatgtacacctgtagtcccagctacttgggaggctgaggtgggaggactgcctgagcccaggagtttgaggctgcaatgagctgtgaccgcacccttacactctagcctgggtgacagagcaagaccctgtctctaaaacaagaaaaaaaagagagaaagaatggaggagaattagattgtgctgtattatagatttaaaaggcactttgacatttattccacaaaattcctttcgatgtttaatccccatcatatggttgtcattgcaaggtggctttttaagtttgctcaggttgccataacaaataaaggctagagattcagggtccggggcaagctcccaacaggaggctcagcttgatgcttctgatagttctttcctccaattctggtcactcaatatttggagctcacccaggcagcttccaggaaagctgctggctgatcctgaccctggagggccgtcttctctgaccctaccacgttaggtgctgcactggaccaagcagccaccatcagtactcccaggcccagctcctatctgcctggtgtctgagaagcccagcccgtgaggaacaatgactcaatcaaactcagggtcctgcagcacttcagaaaaggctggtttgtggcagagtggaagaggagaatgtcacagccttgtccccaggcacagacctatcgaggctaccctctccccaccccctgccctgccctgtttcccttagctacagtgcaaaggtcagctcctcataactcttgccccccttgcaacctgaacccagtttagggaccctctcttggagaaactggttctacacatgcaccccttctcggcccccaggcctggctgctttacccgaagcactggtcaagcttgcctcacctgaccagggcatggcctcctgggtcccggtcctaggctctgcccagcatgctgcctggcagagcgtctggggagcagggagtaggagcacagcttctggcacaggacaaaaccctggctttgcatcagactgactgtgtgaccttgagcaagtctcttcatctctccatgcatcagtttccccgtggataaaatagggagagcagtaatagctacttcccaaggctgtcccaaatgctaaatgagatcgtgcacctgaagtacttaccacagtgcctgggtgctggtatcctcgggggctcccagtcataggcgtgctgagctgcagggcccttattcaaatacaggaagagatcaatatctccacctgctggcatttgagggaaatgtggccaaaggcagtgaaaaggaggtatcccctcgccccacatccccgcctcctcgctctttggcagaatgagtcacacactgtttggcacaggccacagttggtcgcattcccacaggtggctgtgatcagttttgggcttcaggcttcagcagatgcctgcctctcttccttgggtgccttccaagggtgtgcagccttccagcgtggtcctggacttcagcttggactggagctgtctgtggttgagagtctggggagatggtagggtagcgggttgtgggggaggagagacccttgtattagtttactggagctgctgtaacaaggtaccagaaactgagtggcttaaaaccacacgcatttatcctctcacaattctggaggctggaagtctgagatcaaggtgtcggaagggccatgctccctccaaaggctctgggggaaaatctgttccatacctttctcttaccttttgttgcctgcaatccttggtgtttcctggcttgcgcccgcctcactcccatctcggcctctgtcttcgcgcagccgtcttccctctgtgtctgcccacattgccctagtctgacatcagtcactggagcaggctggggtgacactttgttcccatttcctctgtgacagagccagaaacgccagtgagaaaatatgttgtgcttgcctgtgacatccctgttccctggcaccacctgatttaaatgaggcagccaggggttttatactgtcatcataaatgacatcatcctcaacaacgatgtcatcgtcgttatcacgagaggagatggggagaagtcagagctgtctgtgtgtctagggcccctcctggctttcatgatgggagaggccttgtccttggtagcccttccatttccctctggtcactttgagcactccaggccctggccagggtggaagtggagggacagagatgagcagcccgctgacccagccctccatggctcattccttgctttcaccttggccactccatcccctacccctcctgggacccctgagtggcctctttaaagtgccagtctgaacctataaaccccccacctccacttcaagcccatcctgcatcttccctttgccataccagatctagtctgtacattcaggacccctgccagcctctacctcctcctcctcccccgatctcccttcagctggcctgggtcgggctatgcctccatgaagcttgtccactgctcccatggctaaacctgttctgggccctgcagcacagcaaggtcagtttccatgcctctctgcccctgcctgaccctgctgggcccagagcttcaccagggcaggcctggggctcaggcttgtctgcacttccagggcccagggacaaaggcaggagtgactgcaatgtggcttggaattaggctttgctccatggacctaaggaggtctggtttggggtgaagggtccacccccagaaagcctgggagctctatattctctctggccctggccacaccatggccaagcctgctgggcgtcatgccttgcagtacggccagagaatgcatcagacttggagggatgtgtgtccggggtggcctgtggtcatctgggggagggctctgagcgtggctggcaagaggaaagctcaaaggggccctttgtcctcatccccgagtctgcgacatcccctcccactggttttcattccatatttggtctgtgggttttctcagtctctcgtacccctcagtccccaccagtccatgaatgcagaactacccctggcctcacaaatggccactttggataccctggtggggtcacaggctgcggttgcccctgcaaatggttggtagaagcacgggttgggaggtttcatttctacccagaagggcccttgctgtgcctgagggagggctgggctcaggtcaggggtgggagaccggggaaggggcctacaggtcagtggcccgagctcagctgcagcaccaacaaggctcaaggccaaggaggagatgagagcacatcaaaagggggcagtgggtctgggcggcccaccgcactcaccagcccaagaagggggagacttttctcacctgcaacccactgggtctctcctttggcccgcagctcaagaggtgaggaaattgtccgcctgcagatcctgacacccagggcaggactccgcctggtggccccagacgtggaaggcatgaggtatgggggtcctgctgctgtcctggctccctggacaccattctagagatggaagcagcagcctcaggtggcaaatgatgaggcctagggccggctctgccactgtagggccaacaggttgatgggaggcatggtcgacctgggttttctgccccatctcattctttcactcagaaaaccattatggagcaagcgcttagtctgtgtaagggcacaggcccgaccctgggacacagtagtgaacaggaccccctggctggaattgccatctgcctggtgggggaggcagacgccgacatgagcatgaatgaggtcagccagagatgctgtgtgccaggagcccctgggaagtgacagctcaaccctgccaattgctgaagatgggaccagtcagccgtgctggggatgttggtgggggtgggaggaggattgggtctaaggagcccgtgaaggccactgaggccattgccctgcctgtgtgagagggccactgggaatagagtggggtcactgggtcagagtccacagctctccatgccactaggctctgtgctggggaggggtgggtcaaggaggccacaaccagcagggagcacgaggggctcagcctctgccctggggtgggggtcagacagccaggtgacatgcaggcaggattcgggggctggggtggaggctaggagagatccgagcagggagactgggcccctaccttgtgaaggccagggactggggagagaagcgggagtgtacactgaaggtcatcccttaatccctggggtggcaggaacttcgagcagaggcctctcaacagtgtggtgggtgggagtgcttggggagggcttcctggaggaattgacatccaagatgagtcctgagcgatctctaggtccctttaccctcctccttggctcctcccactttaattctgcccccaaggcaccaagtcctgtccactttattttagagatgtttccatccctattgctctgcccctggcccaggcctccactgctactcacccagttgtctgcgaccgtttcctactgtcccatccctggactcccttccacatctacctgggtgatgtttccaaagggcagaagtagttatgccagccccctgcagaaagccctgcaaagcccctcccactatgctctgcagcctgaactcagtacctggccccacctgcaggctcctccctccctgggcctttctctgtgcaggctggaggctctgcctgagatgccctttcccctcttcatctttctgttccacctcaaatgtcctgtcttctgggtcatgtccttctcctgagtttcttccccaggcagcatctgagggcttgtcgattctgcatggcagcatccattctgcatggatgtagatacaatcactatgcccattttacagattaagaaactgagaccctgaatggttaagtaacttgctcaaggtcacatggtccagagcaggcagatccgctcagcctgccctactcccaccttccaccttctgcaccatagctcattgtactagttggggcagggagcagggggacagagaggggtgatggaaagacttggcatttgctgagtgaactcatttgacgagtttattcgtaggcattgaagtcaaaatttccaggagggaggtattttaaggtttgtgattgaggtttgagagagtgattagggctcaagagatttccacgttatatgcagacagaatagagctgaaatcatgagcgtaaactagctttacatggggctcatggtgagccaatggaagctgggcaccgacctcagtatgcaggtggcagccacctggccagccctcctggggacagctgggcgagggcagtctcttctcgccatgttgagagtgggcctcctgagggccagttgggagttagtgggtgtgcaggccagtataaaggagaggcaggaacaagtggagatccctgcttcaagggtggcagttgacaccttgggaggggaggagacagcccagcaagtggtggagcacgccaaagggaggagaaaaaggcggagaccaggaaggtgtgtggccagggaggtaggcaggtggtgttgacaggatcaagggaggaggggtggtgagaaggctggagtggcccactgggtcagcagtactgaatggtggtttgaaataatgatgggactgtctctcctggatttgacaacatggggctccctgaggacctgaaggagaacagaagggggcttaaattaggagattaggatcagggatatagtccagaactcaaatcccagctactcctcttattacctgtgaaatttggggcaaatcacaggggctttgtgtgcctccgtttgctcatctgaaagatgggcatgggtgataacagtgcccatatcctggggttgatttgcagagttaatgcatataaagtcacgagaacaggctcaaatgctcaatcaacagtagctattgccaggcacagtggctcacacctgtaatcccagcacagtagctataaaacaacaacaacaaaaaacaaaaaacagtagctattagtaatgaagttttgataattggccaatctgtcaatcagcagggtttgtttgtttttggttctgttttttaagacagcatcttgctgtgtgtgcccaggctcaagtgcagtggtgccatcacagctcgctgcagcctcaaccttccaggttcaacctcccaagtagctgggaccacaggcacacaccaccactcctgactaactttcaaaaatatttttgtggagatggagtctagctgtgtttctcaggctggtcttgaactcctggctcaagtgatcctcttgcctcggcctctcaaaatgctgggttataggcgtgagccactgcacccggcccagtagcaggttttaagctccgtggagacagctggcgtttgaggatgaggtaacagcccacacctgagtgtgaatggctgctgcatggttaacttccatttctttcctccataggtcttccccaggcaacaaagacaaggaggccccctgctccagagagctccagagggacttggctggtgaggaggctttcagggcccccaacacagatgctgcaaggtaactcagtgcaggaagcagacacttcattcccagaacacggagcccacatacacccagctgaaggacttccatggcctccggtgcaatgtcaatggatgcagctggggccaggaaggtcctgttcccactgttcccccagtacctggggtactgcaggtctttaatgaacatctgttgaaagaaagaaagaatgaatgaatgaggcctggagggaggtaggcccctgccatgattcctcagggagccagttagagagcaggaccaaactccagggcaggctatccccagctcctggcctgtgctgagttccttccattcccctgaagcttccacactcactgtgcttttactgcaggacaaagcagccctgccaatggccagggcaaagcaaggccaccaagctggcagtctgggagagtcagtgaccaaagtatgtgggcccccatagagcatgtagcggagactttcaggatgacccgtggactaagggagacattgtggcaaggggtgaggggtccaggacgggaagttggagccatagcggtggatgatgagtccagatgggatgattgtccccagtcgctgcacagccagcccactgacctgtcctccaagccagaccagtgccaaatgtgtctggtgagcagtggctgcaggctgggcatttcttcagtgagaacctggtagccagttacagctaagaacccacacacccgtcttctcagtgtggatccctggagcccctagctggaaccctgagccctggaaatgaggaaaggaatccctctatggcttattaccagacccacatgtcttgccccttgctctgttggcaatcagctccccccaccaccaacgaactaacctcctcctgactttccaccttgctcccaaccaacccatcaggtttggaaaaaatacagaaatacttcctgttagagtcaacttgggcttggctcagctctggtcagagcagcacagagtagcagccaaaggcctgtgcttctggtcttgaggcccactctcatggcatctgggttagatgagatcaaaacgcaactagagtcagcaaatactccacttctcataacaggtcaagtgcacagttgagtgatggcaatgtgggatccggagccacgggctcccggcctgaaggcttggctgcagtagacatcggctccgagagaggaaggtgagctgcccgggggaggcaggttctctcatgcccctggtgacagaccagggtcaagctgccaggctgcttgggctgctatgggtggggcactggtcacttcctatggctcctgtctactgcttctcccacactcccacattccaccacatcctgtgtccttgggctttccactttttggaatcttgttcatttttctgatccctgccactggccctcaagctcctccagagtaggcactaggcccactcacagctggaggcccagccctcacatggtgctggtcttgggctggtcaaatgaacgtgtagggaatacatgaagggacaaattaatgagtgaatgactgaatgatggaagagtcggcaccttcttacttcttggttaagctctgaggaccagctaggaggccctttgctcctgctttctcccttctctccttttcctgccccatccctaccccaggcagctctgctctgaggttcagggagaggaaaagcggtagccctggagagaccagcgtgtccagctgggctctggcttcttggacctggagggagtcaggggccactttctcaggtgatttgcagagtggcaaggtccctcttgtccctaagtggttccaaaccaagcctgaatcattcttggggcaaaggctaggtatgcagatgttggcataaatagtttagctccaaactatgctagagtccttctggttcagagcagatggctagggaggagtggcaaagccagtgtctgcaaagagctacaaccgcaagatatcatctgcctcctgcatcctactgcagtctggccaaggagggaatcctgtggggaaggccctgctgatgctttcctacttccctcagcacacccagggcccctttccctcactaacttcaatagtttgcaattcatgccatggaaccagagcccgaattctaaatccaggcccacaagtcaacacaggaaggggacagcaggtcctggcctctgaaaccactgtctccgagcaggtccaaggagaggccaccagagactctgttctttaagctgccactaatggggaggactccgctagagccctgtccatgcagcctgcatctttttgccatctgcagaggcattggagggatctttttaaaaataagctagatcacatttctcccctgctaaaaccttctagtggctctccattttccttagaatgaagtccaaaccctttcccatggcccactgggtcctgcatggcagaatctttggccttctatccagtcggggctcctgctactctccccacagtggtgcagcttgactggctctgctgatggctgtcgcggaagagacttctggtctactgtgattgggtggctctggtctcctccatgtcaccccgcctgcttatacaccctcataacatgaagcctgtgctgtccactgtttccttaaaatgaaaccaagcctcaaagttacttgtaaagtcatctgaagaatcttctagattttcatgaattttaacccagtcttttacagttgtcttacctatatagtagtccctaggtatctgtgggggattggttccagaacctcactcatataccaaaatccatgcatgttgaagtccctgatataaaatggtgtagcatttgcatgtaacctatgcacatcctcctgtaccctttaaagcatctctagattattataatacctcatacaatgtaagtggtatgtaaatagttgttatactgtattgtttagggaatgatgacagaaaaaagcctgtacatggtcagtacagatgcagccatcctattttaattatttttcccacatctcatctcatcctctcctctcctctcctctcctttttcagacaggaccttgctctgtcaccagggctggagtgcagtgctgtgatcacagctcacagcagcctcaacctctggggctcaagggatcctcccacatcagcctcccaagtagctgggactacaggcgtggaccaccacgcctggctaacttttgtatttttggtagagacgaggttttaccaggttgcccaggctggtttggaactcctgggctcaagcagtccaccgacctcagcctcccaaagtgctgggattacaggcatgagccactgtacctggtcccaaatattttcaatctgaagttggttgaatccacagatgtggaacccacaacatagagggctgaccacacttagtttgactataattttcaacaaactcctttattgtttttcctttttttttttttttgagacggactcttgctctgtcccccaggctggagtgcactggtgcgatctcggctcactgcaagctccgcctcctgagttcatgccattgtcctgcctcagcctcccaagtagctgggactacaggcgcccgccaccacgcccggctaattttttgtattttttagtagagacggggtttcaccgtgttagccaggatggtctcgatctcctgaactcgtgatccacccgcctcagcctcccaaagtgctgggattacaggcgtgagccatcgcgtcctgccttgtttttccaaaggaaaggttgtttctcatggcaacaaccactctccttttccattcattttcatggatttacttaatcatcgaacttagtgattcttctccattagtggcagctcaaagaactgagttgctgccccaggggcctttccttggatctgctcagagacattggtttcagaggccagggtctgctgtccccttcttgtgcaaatacaactggcataaagaggtctgggaccaaacaagagcacctcttagtgagtgtgctggttagtggagggcacaggcttgtataggcagtgattgttcagcatgccgtgagcatcagtctgcctggtttacagagacacagagaatgtgactccaccctgagaaggttgggtaagacattccccactaaatccatattgagtgggtgaatacaggtggactgggaaggtgcactgcttctataaacagccactgggccctgtggtaacaggaacacattagcacatgttatggcccaggcattattcaaagtacttggcatctatgaactcatttacttttctcagaatacttacgagacagacatgattagcatccctatttcattgatggtaaaactgaggcccagaaaaaaaggtcaggtaacatgcccaatgtcacacagctgggagatagcaaagccatgatttgcaacgccagagggcaaccactatgccacagagccccaggtgtcaggctgccttgagatataaatattgttcctcaagcatccatttgagcagcttcttggtcctcatcatctgtggggggcaggatccactttctcgggagagggtagacatacagacacaaagtcctgaacctggaccaggtctggccttctttcacaggctgtgtgcagctgctagctttgcctctttcctggaagaccaggatgggcacagtgccaactctcagtcctgcaagcctagaccagcagccatcaggtaaggttagggccactgccctagtgccctatcccattgccagacacagcctttggggcccagcctcagctgcagcaccccaggatccccctcgaacttctcagctccatgccactttcacatcaggtgatcacagcaagacagggaactccagggggagctctgaccaggggcagtggaagaagagggatgggtgatatgtctgctcacccagagagcccagcaccaacctacatggacccaagctgaggtggcagagaggagggcatctgaaggcagagcctgggaagagatcctgctaggaggtctcagagaacctctgctgtagggactacagccaggtttagcaagcaggagtcagggagaagattcccaggggcagccagcattagagggctcagttcccaggagcacaggaccggtggctgggatgggcaaaaatggctcctggggcacaaaggtacaatgggaagaagctgtgcattcccatgctgtaagcgtctgccctgtttcacccaccaatccaccagtgggcatggccactttgctgtgggtgtgtggagcatttggcaagtcctagtaaggaacgatctttcttaactcccataaaccctacagaggtgtaggtcaggtaaggatacgtcatgctcagggtcaggttccagccgcagctgagggctaaggggaatgggtggacgtggggcagggagctggaagaacactcgagagatagcaggtaaatgagacatggctttactcagcagcagctctcttacacagctttctcaaactagctttctcattagcagcttactctcacaccgtctgccctgtcttggctgcttagtccggtggcccctacgcacagctgcgtggccagctctcccttgccttcagggtcagcagcttaattctttctctccctgggcacgggcaagccaagctgtgtcctggctcccctctgtcctggctcccctctgtccacctgcaaagacagacagctcttgctctctctctttctctaggttcccgtgcacccgccatgtcaagctatgttgagctgagccaagccccaagagacatgtcccccatacacagcgtcaacagggcagttataccttttacagacaatagtggtttagagccaagtatgaacttacataaacaggttatataagaagtggaggtgtgcacctgtgcaccagactcattgagtcatgcaggcctggatatccccctctgcctattccttgaacaaagcacatccaggtaccttacaggatactagaacccaaaaccaggagacttccccagggaacccaagttggtcaggggcagtgtttgctcttgaactcaggtgctaaggccatgtccaaagctgacatgaggttgtcacacacagtggcatcggtgccacactaatgccaggactgagacaccagcctttactggaagacacagttcctccctttctggtgagaaggcagcctggagggggaagacctgggccccagccttctttggtctgagatctcagcaggcctgtgtttccttcctcagctccagtgccacttcagtctctgctgtccctgctgataggaagagcaacagcacagcagcccaggaggatgcaaaggcagacccaaaggggtaaggcatgagcagacagtgctgaacttctggggtggagagaggcagcttgggctgtgtgtccattggcctttggctgggaaggtgaggccagcaaggtttgtgagctggcctgaggcacatagcaagggcagaagccccaaccagaaccctctggcttctggggccagggagctttccactaaactgttgccttggccaggaaatacatcatagtcagaaagggtctttcagtcagcaaccactctgacagcaactgccttttgctggaggctggagcatgcagacaaatcagaaacacctctgccctccaggaactctcaggcagggggtgggcaaaggctggtccagattagagcaatacatgagcgctagagcaggggaagggggcttcatggggactgtatgtagctggatgtggtcagcgatgagtgtccttgttggggagtgctggaagaggaggctcagtgaactaggtagggcttgattggcctcttgtactgtgatattggagtccactgtgtgcacagccctctactcacagtgtctcatacggttctcctcacagtctctcaaaggtttatgcctaattacaacaaaacccaaaagcctggagcctaggtctctgtgcctcctgggaaggatagtgctccgaagaaaacagccgcagctgagatagagtgatggcagtgaggagggtactacttaggtgggtggaaaaggcaactcaggcgatctcctctaaagaggagaaggagccaactctagaaagaacacggtggagagagctatagataaggaaccacaaaccaactaaccctgaggtgggaacatgcttagcatgttccaaaggacagagtggctggagcttggccagtgaggagggccacagatggagcagggccttggtaagccatggttaagagattggatcttatttcaagttttaagccaaaggggagtctcatgtgatttaggtgtttaaaaggtgaatgcatgtttgcattttcataccacattgctgttgcttttttacttaaaccaagatgctgggggctggggtgggcaatggatatctaaggtatgaggccttattgtgtttcttttctcattcgaattgcactgacaattaacaatcagagtgaaaacaacagctgacaccaatactgtgctgtgctaggtgccttacagccttcccagcaacttgtgagatgggtaaggtgggaaactgaagcatagaaagattaagtgacttagccaaggccttacaagtggcagaactgagttccaagggaagaggctctaagaaaatcctcaggagaaactacgaaaaactagtttatgaaatcttgtctttggagcctagtctcaagacccagaatcagtaacttacagctggttaacatggttaacatgctgtgtgatctcaccttaattttccccaaacgtggaaaaggataaggcttcttattatgcaacttgacagaggagaaaattgagggactcactcctgtaatgaacacacttaggaacagagcccagatccagccaactctagagccaggctcacgctactttcctctgatgtttaaacgtctgcaaaatcagaggtgttttttttttttttttttttttttgagacagagttttgctttgtcgccccagctggggtgcagtggcgcaatctcgactcactgcaacctctgcctcctgggttcaaacgattctcctgcctcagcctcctaagtagctgggattacaggcacatgccaccacgcccagctaatttttatatttttactagggatagggtttcactgtgttggccaggctggtctcaaactcctgacatcaagccatccacccatcttggcctcccaaattgctgggattacaggcgtgagccactgtgcctggccaatacaaactttcttgattacagtgtttcacaactctggctgtacttgagaatcacctaggaagtactgaaatacactgttgatgaaaaaggccatactctgtaaaatatttgaagaaattctgagccaaatgttaggactatgacccgtgacacagcctcaggaggtcctgagagcatgtgcccagggtggttcacttacagcttggttttttatgttctagggagacataagacatcaatcaatacatgtgaggtatacattagttaggtccagaaaggcctaggtatacattagttaggtccagaaaggccggacacctcaaagctgggagtgtggtgggggtgggggtgggggtggggttccaggtcataggtggattcagagattttctgattggcaattggttgaaagagttgttattctctaaagacctggaatcaatagaaaggagtgcctgggttaagataaggggttgtggagaccagagttcttatataggtgaagtctcataagtggccgcccttagaagcaatagatggccaatgtttcttattcagacctttaaaaggtgctagactctcagatcagaaaaagtcctggaaagggaaggagattctctacagaatgtaaatttcccccaggagagacagctttgccaggtcatttcaaaatatgtcaaaaaatatattttggtgtaaaatacttcaatttctttcattacctgctgtctgtcatgtgatgctatactagagtcaggttggaatttggcatattattgcttcaaggagtctgttttgtcagtctgaatatctctctcaatgttaatactggtcagttgggcatgaattccaaagggaggagaatatattgaggcatgtctgaccttcccctttctcatcatgacctgaactagtttttcacgttgtgtccccttggctgagagaagtgtccattcattcagctggggagcttagaattttatttttggtttacaacacaacaaaaacttcccgaagtcccaggtagagatttggattttatttttctggggtgggtctccatcatgtgtctttttcaaagctccccagtttgttctccttccaggctaggtcgagaaccatcgttctcaggtagtggttctgacccaggggcatctcccaaagcttccagcctgctacgatacaatgtctggagccatttttggttgtcaaaactgggagtgggagacactactggcttcttatatgcagagatctgggatgctgccccacatcccccaacacacaccatagaattatggggttcaaaatggtaatagtgctaaggttgacaaaccttgctgtagagccttgacgatctatttgggaagacagcagggacggaaaagaaaaagggatggcacagaaccacacccctcaccttccccgaaatctgggtagcgggcacaggacgtgtgcgcctgcgcgaatgcgcgctcgccaccagcgtacgcgacgcgtgcgcgcctgtgcacctcggcgagcacgcgcccgtagtgagtacgcctgcgtaggccgccatttcttgaagccccgaactcggtcgcagtgcccgccgggaaaatgcgaccgtccacaaagtgaaatggccgcccgggacgagctcggcctcggcggggattctcttgaggccatgcccgtgccggccgccagaggtcgcccgaggatcacgaatgggcccgaggagctggctgccccttcccccgcgtaaggtctgaagccgcggccagagtggctttggggtgaccgcgcgtggaccgtcgccggcgggaggaagcgcggtcccgcgaggggccgaacggggcccctgcggcttgagcttgtttcgcagggagccctggggccatggcctctgggacactggacacgggtcgtcagggctgcccagggggagggggtgtggacgtgcagacagggaaggcagctggaccctccaaccacgctgggccctcgggctgaccggggctggtctgtggggcagtgaggaggggcttcgttccctaggagtttgatgagggagcgccatgggggtggcgtcatcctgacatcccgcagggcagtggagccttactttccctaggttacaacacagttttaactgtcccaaactgtggggactccgccctattccatcttgggccgctccatcacactacagggagaggcggtatagtatagtggttgagagcctggactctggtgctttgggttccagtccaagctctgtcacttacaagcaccgtgaccttgggcatgttactcatcttctctgtgcctcaggttcctcacgtgcggaatagtggtaatcatacctcctaccatatagggttgttgaaatggccaaatcggtttgtatatgtaaagcctgtaggacatttaaacctgcgagctaagtgaagcagcaccagaggaatatctcctcctctcagaggtgttcagggacacctggaaagctaacttaaccagctttattggtttgatttcatttgacatgacacgatatctcatcttcttcctactaaacttttgtcatcaaattttccatctagaacatgctgttttcctcattatgttgcaagcatgggcttctcgtttatattttttctgcatgaggatcaggtgaagtttaggcaccacatttcctcaccactggcaaccgttgttggccagtggaggcagtacaagggtggaagtgtcagctgggtgcagtggctcatacccacctgtaatcctatactttgagaggccgaggcgggaagaccacttgagttccggggattgagatcagcgtgggcaacgtagtgagacctcatctctacaaatattatctatatctatatatgtatatgtatatgtatatcatatatatgatgtatatctcatatatatatgtttttgaaacaatgtttcacttctgtcgccccagactggagtgcaatggggtgatctcggcttactgcaacctctacctcctgggctcaagtgattctcctgccttaacctcccaagtagctgggactacaggcacacaccactgcacctggcttatttttgtagagaggagtttttgccatgttgcgcaggctggtctcaaactcctgacctcaactgatccacccacttctgcctgccaaagtactgaaattacaggcgtgaaccactacgccgggactacaatttccgttttttaaaagaatggaagtgtgtagattatggttgtgttaggagttgacagtggctgtattaggctactggatctttggtccaattacactcagaaggaaaggcttcagagaaattaatccaaaatccaaaatcccgttggtcaccatcccctatgttaccttgcctatctctaaccacttgacttccaggaagttcatgaggagctcggacaggatagctgggaagtaattcccctggatgttacattgtccagcagagcttcctgtgagtgtttgcctaagatttcctttttatgacccacataggtcatatgtcctaaaatcacagtggccctgccacaggcctaggaaagaagaagccttgttcatccatttgtccctgtgtcacaatagagcccaaatttctctttgtggataatcctggctctatccacagacttggtgagggcaacctctactagtgtatttctacagaggacgtgggacaggacgggactctgattaaatccatagtaaagctaactcagggctaccacagtagggagacaagctcttcaggccttgtatgtttgtctttggctcaagcaagcatgtcactgacagagattgaatgggtgtgtcagggcaccctgctggcaaccctgggactggtgttacctgtgcagaccacttttggatctgcatgggctgcagcagaccctaagggtggaagcagcacagagaagcacaggcccagtgggatggttccccacagttactgtgtggcgtcacactcacttgcctgcagttctgcctggtgcagctggaggtggcaattagcttgttgtgcctgctggagaattttagttcccttgacctccacctgaggctgaagaatcatgttgctttcagggcatactttccaaaaagtgtggcctctgttggccttgttattccagcttgaaggcaggaagcctgcctagacaaagttaactcctatatacaaagagtcccagggtagtttgtagcgtgttcttgtctcggggtagcccccaccagctattgaaggtaggctggtgatgttgggaaggttatattcagagtgagctaggatcgaggtgatggcgaagtagattttcattctgaaatgctgggctcactctcttagtagcccaacttggtgtttgcccctggcctagtagactctggaagcagtaccttgcacctcggtgtggggctggtgatgggaggggtgtggaagtggaggatcagctagcagcctctttcccacggtacccagattggagggtgcagtgcaatcatggggtgaggccagggaggacccctgaagagctcgatgcctgagacatctgggggaagccctgtccttcttgctggattcaggggtggcaaaagccaaaaattggagggccaggtgcaatggcacatgcctgtaatccctgcactttgggaggccaaggcaggaggatcgcttgagaccagcctgggcaacatggtgaaaccttgtctctacagaaaaaaaaaaaaatacaaaaattagctgggcgtggtagtgtagacctgtagtctctgctactcagaaggctgagacaggaggatggcttgagcccaggaggcagaggttgcagtgagccgagatgatgccactgcactccagcctgggcgacagagtgagaccctgcctccaaacaacaacaataaaaacatcggaggcttcggcttcatctattacacatggaggcctgttcagtgagaagggagcagcgatgctgggctcctgccaaggaggagactgtctgctccctggaattggggctgtgcctggctcctttctgccccgctttcagggatatgagtccctccaagtccacaggaggtgacagccagcttgcgtcctggggctgaggcagggttagtttcagagcacttttttcataagggtgcttattcttcttcagggccttggctgattatgaggggaaggatgtggccaccagggtcggagaggcctggcaggagaggcctggagctccaagaggtggccaaggagacccagctgtacccgctcagcaacctgcagatcccagcaccccagagcggcagagcagccccagcggatctgagcaacttgtcagacgagagagttgtggcagcaggtaagggctgagctgcagtgggctctgcctctggagcccatgtttttgttgaggtctgcgacccacatgggaaccacttccccacaccctgtgccaatacccgacacattgcacacccaggctcctgttctgtgagtgggtcatggtgattccctggtcctagagcagtgtcatcaggcttcttgtggctcaaggagctgggaggggactgtgataggaggatgtgtctgtccccaggtgtgagaagccctggctaattcccaatgcatggggcaggaaggaaggctgtctctcagagtacaggtgctctacaggtgggggtcctgggcagagtgagggctatttgtgtgggtaaaatgccattgtcagagaaggacagagtgtgaaagagcaaaaaaacaggagggtaaaagtgcaaaagtgacagagtgaagcagagagagagaggccagagggagagaaagggagcatgtgtgagcaggcatgagagagtgacacaggatgtgactggccatgtgttggtgtgtgccactgtgcatgagcaagaggacaaacgtgcctgttactggagctgaccatgtggcattggtgtgagagtttcaagtcaggctctcttgaaggcatcttgcctgccagcgcaaacactgcatgtccttgcagctctggacacgtcaacaggccagtgattccaggggtgcaaagcgaacagtttcttacacaagacagaaatgtagaaggagagagctaagactcatattgccccgagagaggagctagtggaatccagcagggcatctgctgtggggagcaggtggagcctggggttccttttgcagggatgaaagaaacacagtcatctgccttctttgttctggggcttcttgtaccacagaggttccataattattaatagttaggttatttttagggcctagctcaactgttagataacaagttttaccttctaagaatatctagcccatctttgattccttggctccaggccctggagggtcccagtccaaaaacagagtgaacaactttggacttgctgtcacattgtgtggcttctagaactagtcagtgttccatgcagaaggggtataaaaagtgaggcttgtggatgaaggaggaggcgagtggttctgggttttgttttcgttttgcgggggagtgtcaggaaaggctttctttacagggagagtgatgttggagctgggtttggaaggctgagggagattttgccagatgtgccagacgtgcttgggaaggcattccgagtggaggctcacaaagtgtatagggaacatccagtcaggtagccatcacaaaggagggttaatccagcctggcttggcaggaagcaccaagtaggggctgggcaggcacctgctcctaggctgaggagtgtgacccacatcctgagggccttgggagccaccgatggttttcctgcaggagagtgccacagccagactcgagtccaaagaagatccctccattgccctgtggaggaccaggccaggggagtatacgacgagacaaggcaggaggccatattggagactgtttgcttacaccaggggcaaggtgatgaggctgcaagtatttttgaattattaaaggtaaaagcgggcttggcgtggtggctcacacctgtcatcccagcactttgggaggccgaggtggcagtatcgcttgagcccaggagtttgagactagcctggggaacacagcaagaccccatttctacaaaaaatttaaaaacattagccaggtgtggtggcacatgcctgtagtaccagctacttgggaggctgaggtgggaggattgtttgagccttgcacgtcgaggatacagggagccatgttcctgccactgtactccagcctgggtaacaaaacaagatcctgtctccaaaataaaaataaaaaaaataaagataacggtgagggaaaagtggtagccaaggttgctccccagatttcagggctaggcaattggatgggtggtgacaggaactagctgagggtaaggagtttgggggcaggcccgctgagagatgcacagagatgagaaggtcactgggccatgccgaatgagaagtgcctgtaggggctccagccagtgatgtccagtaggctactgagtaaacaaatgtggagttgagcaaagatctgacctggggctagagagctgggagttgtcagctcataggaagtcactaaagagaatgcatgaggttgcctggagaatgcctttggaaggcagtgtgtacaaagcatgtattctcggcttttctctgcagacttccagggacagttgtccagccaggcccttggctgggtgggtgagtccacgtggttcagggatgctgagggaagctgcttcatcagctgacatttctctccattttctgctcttcttttgtctcaaaaagaaaaaaagaggggatattaattattgatcccctaaaaccctagctgaatatataaaatgaaaagaagtaaaaatatgagagaagcaaaggcagatggaccataattttggaaaataattccaaaaggtcttaaggaggaagaggagctacagagaggtattgagaaggaaaattttggataaatggaagaatcaggaaagactaccgtcatggaaaccaagccacgctgagctaactttccagtgctctgtagatgctgaaataggcccatcagatttggctatgtagaactcatgactgccttgaggggagtaggttggggcagtgggaaaggctgtagttggattataatggattgaggagggagcggaggataagcaggtgcagttgatggggtacacactctgaaactggctgtgacgtgatggatgtgggaggggtgagcagataattacagctacaagataatggggaaggtttcctataggtgaaagcaacgtgtgcatgttaggtaaaggctgggcagagggtgcctacgtgaccagtccccgataaaatccttggactctgagtctctcatgaattgccctggtcgacagcatttcacacttgttgtcacaactcactgctgaggggaactgagtgaatcctgtgtgacccactgggagaggactctggaagcttgtgcccgggttccctcagaaatttgccttgtgtgcttttccctttgctgattttgcttcgtatcttttcactataataaaccatagccttgagtgtgatgatgtgatgtgtcctgtgagttcttcttgtgaatcaccaagcctagggatggtcttggggacccctgacacagatgggcaggatcagaactttatgccataacaaggactttagattttctttcgagggcaaagaggagccaggaaggtttgaagcaggggagtgatatggcgagagtattgctttgcaatgggatctccagtggcagtgagaagagtgactgaagtgggcagagtggagcagggagaagaggaagtgcttacagcatcctccatgtaagaaatgatggggcctggactaggggactagctgtggagatggagacagaactgtaaaataagtagaagagatcccaaattggatgacaggtaagacttgggagagcagtgacggagagggaagtgacaatttagaaagccacatttctggtcgagtgagtggagtatgtgacccctcctggcttaggtggtggccaaagtatctctaacctgcctctatactgcctgcaactgactgagcaaatgcctggtccgtggagatcccaagctgacaagggcacctgaggcaagcctctggctttcaggtggaggccctacctaggctggcctggctggattgccctggcacactgctgttttgctgaggcagacagcagcactctgcaagtgctcttctcctgttcctcttagtggtctaaatcctgtagcatgctggggtgcgactgtagacaaatcccctttccgggccccctggggttctctatttgcagtctttgggtctggtcactggcatggcatctcagtaggctaggttcatcaggaagggtcaactatgtcatggcacctgatgggcagcatttagagtctgtgggccaggggcttaagggctgcttactgctaatagttctaagtagcaagcattccctcagccctagtctgggcacacgccaggaagaaagccactagatgtgctctcctagtggataactagcctggagttccaagaagggcagagacaggcagagtgagagccttcagagatgtaggcaacgatagtagcagaacttcgagggagagtagatggaaaaattaaaaaaaatccttgtcattatttttaaatgtctgaattgaccagattagaatctttgagagtctagacactagggagatctcatgggtgggccagttattatatcatatggagggagagtacgtatgacccagcacgagaggaccagaggacagtcagtgctaagggtaaaaccttaggccatgggagattgagtttttcatcagttggcaagttttcactttaatactccactgtttccatcatttcagacgactggggatgataaggacaatgtaatttgggggataaaggaagaactcattatatttcttggatgactttactggggaaatggattccttagtcatttgaaagaagcggtagaattccacatgtggggaatacttgttctaacaaaagcttaataacattagtggcaatgatccttttatataagggaaagcttcaagccagtgagaaaaacataaataaactagtaagaacatatttataaccatgagatttgggtgcagaataaaatcaaattggcagttcaggaaaggtcctaaacatctgtatattaacaatattccatcagtgagcaatgtgaatttcccataattgaaatgatgattgataaccttgtattgttcttatctaatataaggcaaagcagcactggggctttgataaagagcaatatctcatgtacactgaggacactgaaaccccgctaggaattctatggaatttctaaaatatttatattaaggacattttacccattatagactaatttagggaaggttctgcattttttttttgatttgacaatgtttccaatgcaatttatacaatattaaataagactaattagtttttgcacctttcttgttacaaggtgaaagaactaatcctttgagattttccagaaggtccctggcaaatcccaaagccagttttaggtataaaatatatttaagttttgattgtgggaaggcaaatgttaagagttgtcaggagttctcgaacatttgattgaatagcattatgggttagcgagaaatactacttggttagctagtgaatcagagttgtaaaaattttcaagtaaacatatgaggtaacatggttgtaaagaatcttcagttcctttaaaattgaaaagactttaaaaaaataactaaggacataataaactgaacatacagatagggcattacagtattttgataagacataaaatctttgcctcttaggcagatgactcagaagaaaaacagaccatttataactttttattagggacagaccaatgatcaagaattttttttttttttttttgagatggagtcttgctctgttgcccaggctggagtgcagtcgcgcgatcaccatgttggccaggctggtctcgaactcctgacctcaggtgaactgcccacctcagcctcccaaagtgctgggattacaggcgtgagccactgcacctagcctaagaaaattttgttattttaacagagaaaccaacattttaattttatacaagtataatatttgatattagttcttttttgaaaatcttataaatacactgaataaaagttttaaccatgacaaataaaattccttttctgtgaacattttctaattttaaagatatttgtttacattttgtctcacacatttttaaattatttgtcattttaatttgggacaaagctattctctttttccttaggaaaagcatatttgcatacaaagttgtttccctttgccatttttgccattattacttttagcagtttatatatatatatacacacacacttatttacttattataattttaaccattaataacttctctttcacagagaaaacaggaggtaggtaattttgaaatatcatataccagcattttgtagcagactagtaaagcttatgaatatacatctcataactttttatagttgttatatactttttatagtaccattttgcaatgtggacaaatgaacacatttaacagatccatatgtagtcacactgtaccataaaaaaagcaaaaagtatataaacttaaatttaggtctagtgactaagtattttatcttctttataaatgatatttaatgaatttagttaacttaattcagcataagtctaaggttttaagttaccaaaaagattttagaaactgcctttaagcttacatattataaaacataattactgttgaaataaagtttgccagaataatgactcagtttggttaaaagcaaatttaaatttttataatcttaaacatgtagtagatataatactagcttattcaacatgtaaacctgtttaagtttaggaggaacatacccaagtagagtaaaaatatatgcttgtattctgttgtattatatgtaatgctgataactcaaagacacataggtgtctattaaactaacaatattaaactagttttgtttgccaaaagtttacataaattctgtgaacttgagttttaaaagcatttgggttagtttttataagaatacttttttgttgtttacactgaaagtattagaagttgtttccttaatttatgagagctttataataatttatataagtacttatttatctctaagtcaattagaatagaggataagggattttgtaaattaatttggtaatgccatctggaggtactgaactattacacatatacaacatacatgtatactaaacatacagacagacacaaatagagatctaatggcgagccctcaatgggtgcagggggcctgaagctctactggctataggcagttgagagggctgagtgggaaggggaaagcctggtgaagagtagataggggtatgtaggaggtagaggcattgaaggggacagatgaaaagattcagggagctgaagggaaggtccaaggtggtgaaaagaagggaagagggatgcggtaggaagatgagaagggggaatcttagatgagcaggtttggggagaccccaggttccctaataaggtcactgaagttccaaattacccttcgtgattactttttttttttttttttgccagttttggaaatactggacagaatgagtgccataggggcagggcatgtagtcagcaagggaggaggaggaggatgaggaggaggaagggcacccagtagattgagagttacctgtgggaagaggcagatcaaatagagaaaggagccaggctggacagtctcattaggaagttctgcacacagtcgtcatctgggagccaaagtttctcttcagtcctcattgaggagctgaagggctttccttgtgcaatctctagacaaggtgtcaagggaaacaatgaggcctcacaaaagagccaggaatttggagtaaatctccactcaaaaggaaccaagaaaacttctatccaggacgattctggctaaaattgaaaaggaccaggaagagtcctgctcaacagagtcaggggttaaatccccactcaaaaagagctaggaagagttctgtctgcgaagattcttgctcaaacagaaaagaactgggaagagctcatttaacagaatcaaagtaactgaatcacagaaccataaaaagtgtccaataaaagcaaataccgtctctgggcagggtgcaatggctcacacctgtaatcccagcacttgagaagctgagggaggaagatcacttgagcccaagggttcgagaccagcctgggtaacatagcgagactcctatatctataaaaattttaaaaattagccaggcatggtggtgtgtgcctatagtcccagctacctgggaggctgaagtagtggaggattgcttgagcccaggagttgaggctgcagtgaactattattgcaccactgcactccagcttgggtgacagagcgagaccctgtctcaaaaacaaaaaacaaatatggatttagatagagacttttattttattttattttattatttttgagacagagcctttctctgtcacccaggctggagtgtaggtgccatctcagctcactgcaaccaccacctcccgggtttaagcaattctcccgcctcagccttctgagtagctggaattacaggcgtgcgccaccatgcccagctaatttttcaatttttaatagagatggggtttcgccatgctggccaggctggtcttgaactcctgaccccaagtgattcacccgccttggcctctcaaagtgctgggattacaggtgtgagccaccgtgcccgaccaatactttatttaaaaagactattgcaatagggacaatgctgcaacctcaggacttgcaaacatcacaaaataatacaaaaaacatcacaaaataataaaaaaaaaaaagcctttttttttcagtagggagtagtaagcacagctagcagctcagctactttcaagggccagtgggcaagcaaaggggaacctgtttggcatgatttgaccagaaatgtgtttccctgtggtcagccggttctcaggagaagctgctaagtggggcatgttctgcattgcagcacttacttaaccaggagcaagcaaaattcaggccctgtggggaggacagaagcctgcctaacattctgtcaaggcaaaggagagggtaaaaagcagacagctgtgaacacttgatcatccttcaggcaataatccattctgggtttctggcttaagactcttgagaaacaaggggaaacaactggtaggagcagcaggctcacctatatgtagttccgtgaggtagccttatggacttctgccaccttccaaaactcagcatgtcccaaaccatctttatcaacacagcttctcaccaaaaacaaccaaataaaacaaattaactaatgtactaattctgtatctccccctgtgttgttcatctcaaaaaactgttatcacctcattgactcagactctcaaccagcgaggtagaagaaatgtttgggggcatgttaaatgtaacacctatgagacatgtaagaggtgaggtgcaggacgcaggtacatggtgataaaagaaaaacctcagccggattaaatttaaaggagtttcattgagcaatgaactatttgtgaatcgggcagcccccagaatcacagcagattcacagagactccagtgcagctacatggtggaagatttatagattaaaaaaaaggtggagggggggaaatgacgtacagaaattggaagtgaggtacagaacggctggattggttacaggttgggggtatgccttatttgaacacagtttgaacactcaccagtgtatgaatggttgaagtatggccgctgggattggccaagagttagctattgttacaggtacacactcctaagttaggttttcaattttgtctgcctctaggttacagtttattgacaaagactcaaatatagaactatggagtccttctcaggccgtatttaatttgctttaacaattccccctttttggtcattttctcaactttgagagattgacaaaaaccttagttattgatatcactattacccttgtaaatgtacttatatggtcttgaaacccactgggaaacaggaggacagtgggttttgtaaggagagaataaggactgagtagaaggtacctctttatgctagaatgttctgtttacaggacaaaaacaaaacctggtctgttttaataactatttgtttccttaaagtcttagtttgattatgttacatttagcatgagcaactccattttgtttggtttggtctgttgggtcctagtgcatgagctcagtacacaacaatggcttgccagaattttgtttaaaaaattccccttggctgggcgtggtggctcatgcctgtaatcccagcacttagggaggctgaggcgggcagatcacgagctcaggagatcgagaccatcatggccaacatggtgaaaccctgtctctactaaaaatacaaaaattagccgggcgcggtggcatgcgcctgtaatcccagctactcgggaggctgaggcaagagaatcacttgaacctggcagtcagaggttgcagtgagccaagatcacgccactgcactccagcctggtgacagagcgagactccacctaaaaaaaaaaaaaaaaaatatttccccttattggccaggttctcacttaggtgagagtgtgaccaaaacttagggccttagcaccacttttagttacctagttaccatcattttaggtttccagtctcagcatgtcattcataggttatgatgtcctcataatcatacatttcaatcagttttgttattccagttgaagagagaccatttgacatttcagagatggctgcatgcaaacatttgaaacctttgagagaatacagtgcactggggagactactatgactaccagtaggataatacccagagtttgaagtatgctgtttacctgaggtccccataaaacaaactgcctaaattaaataaaataaagaatgagctagacgaagagtctactcacttcactaagtgatcttttcattaatcctgtatgactgaatttttataatctgcacttgatatacatattagaattttagaaaccccatataattttggaatatatattaatataattcactaaaaatataccctgaagattaaacattatttttattggccaagcgcggtggcttacacctgtaatcccagcactctcggaggccgaggcaggcggataacctgaggtcaggagttcaagagcagcctggccaacatggtgaaaccctgtctccactaaaaatagaaaaattagccaggcatggtggcatgcacctgtaatcccagctactcgggaggctaagactggagaatcgcctgaacccaggaggtggaggttgcagtgagcagagatcatgccattgcactccagcctgggcaacgagggcaaaactcagtctcaaaacaaaacaaaacagtatttttattttgacaatgcctcccatgatttttataccaaataagccaaatgtcactgttgcattagtgcattatcgatgtcaaacccaattcttaaataaaaccttatagacaaatgtattcaatcttaatcagtttgaacataaggtaagaattttataaaccttttataaccctttacaatttttgttgaagagcagattagtgctctaagaaaacctgttgtgcttttatgtccatgttcaatttatggaaaaacctaataatacccttttaaatttagtattatcatacataaaattttttacaaggttaattttttttttttttttgagacggagtcttgttctgtcgcctaggctgacagtggcatgatctcggctcactgcaacctctgtctccccagttcaagcagttctcctgcctcagcctctggagcagctgggactacaggcgtgtgccaccatgtctggctatttttttttttttgtatgttagtagagagggggtttcatcatgttggccaggctggtctcgaactcccaggtgctcaaaggaaaatttaagacagtccatggaggagaaaggtatagacaaggtcatgcagatattaaaccagaaaggacttatttcctaagccaggaatcgaacccagactgccactgtgaaagggcaaaaccttaactactgagcccagaaggagtctagagtagttaattttgagcttgcaaaggcttttaactagtcaagataatttttagaactaactatgatatgaaccctaaaattcctgttccctggaaggtagagacaaggagaaagtactgccacatggttacaaggtcaagctcccaaggacataaaacaggatggcgaccttgtccagttttttgttggtttcagggacctgcagcaaagtttgtcactgaccagcttgctgggccatcttgagcagcaagcttatgggggcccaagcccatgttttatcctaaggtacccctcgacacagaaaaacgactttatagcacaaaatataccagattgactacagcttaagactagacagcctcagaattcctttttgcattaattaaaattttacagaggagataaacagtgattttacaatcagtttgcacagagagagagaagcctgaaatctgactgggaagagatatttacccttttgctggcatgccaggcttctgggctccctttccctgagtggccctggtgatctggctctctgcaccattgccccgggagccaagccacaacacaaaagaatttttttttaaaatgcacttcagtgtgttgttgttcatttggaatgttccactgtaagttatctttcgtaagatgtcaccatttctgtaagaatttgctgcctcccgggcgtaatgtgtaacccagaaggaactcagttttccagaagcaattaataggttccatggaatgttgatggtaagaaaggaaggaaaaggtgacaagagtgagcgtagacagctctttctaaggagtttggctgctggaaggggaagagaagcagctggggttaggtgggaggaactaagtttagagacgctaaaagtgtatgtagcaggagtcacctgatcaggttgaactgcagcaggaacaaggaagttccattttgactactattagttgcaaattggacccttatgtcaactttttcatctgtaaaaaaaaagggatggccaggcacggtggctcacgcctgtaatcccagcagtttgagaggccgaggcgggcggattgcctgagttcaggagttcacaaccagcctggccaacaaggtgaagccccgtctctactaaaatacaaagaattagccacgcgtggcagcgggcgcctgtagtcccagaatctctggaacccgggaggcggaggttgcagtgagtcgagatcacaccactgcactccagcctgggcgacagaccgaaactccgtctcaaaaaaaaaaaaaggggggcaggggatgaaaatgctattgctttccaggaatagctatgactacttccaataaagaagacaagaaggttccacatgtgaaaactacgcggtcacaacgataagtgggcgggtgcacgcacgcgcgctgagatcgtgcgtgcacaggccggggtgcggccggcgtgagtacgcctgcgcgtgccgccatttcctgcagccgcagactctgcctgcggtgctcgccgggaaatgagacgatcaacaaagaaaatggttgttttgggcgagatcgaccgtggagaggctttttctgcagcagtcccggttcctgccgccagatggcgctcgaggatcacaaatgggtctagggttctcataatggccccgcctaagaaattttggattctcctggcccttcccccctttgtggggtcaacagcggatttgggaatctggtgaccaacacgtgcgcactcccctacccttgcccctaccgagccctccagggtagcttgggggagaagctcctccctagactgccgggtatttgatgagcctggccagcgcacaggtcttgagcaccatggtcagggaagaaggctgaatggcttaggtcttcctagagaggccggaggcgggaaagaactggagaaaggagagatggcagtgggaggatggggacaagaataccagtgtgtttccagccagaagacgatgtcttttaacacctcattgaagtcgtcaggtgactttgcccttgtcagaaaggagcagcactgcgggggtcctactgaggaggagactgactgctccttggggtggggattgtgcctccttcctgtctgccccactcttggggagatgagtccctccaagtccacgagacatgacagccagcctacctgccatgggagaacaaagtctagtctcagggcactcacttcataagggtcttattcttcctcagcgtgttgactgattttgaggggaaggatgtggccaccaaggtcggagaggcctggcaggacaggcctggagccccaagaggtggccaaggagacccagctgtacccactcagcaacctgcagatcccagtaccccagaacagcagaacagccccagcggatctgagcaattcgtcagacgagagagctgcaccagcaggtacgagccaaactgcactgggaccttacctgctagagccagtgtttttgtccagggcagcaacccaggacaaacccccacacactaggcatgcctgtttatcctctgcaggtgagtgtggttaggagccagagggaaggagagaaaccagcatctcaggggtagatattcatgggtttcagcttggagccatagcatcaaatctgttagactaagtctggcacagaaaggatgcacagagaaccaggttgtctggcagccagttcgaacctggaaacctgggtcaggggagggatataggttgctttttctgttaatggagatggaaactctctgagcaaggtgtgccatggtgtggatgtgattcactgccagaaataacaactgtaccagttggatgagctcttccactgccatcagcactgggatggccatggatttggacagtaatgtagctccacagtgctgactcagggttgctcattgattgcaagaagttggcagcagtagcctgaggaaacaggggctctgaattttctgagagagaccaagaaccaaggaacagccaggtactagggaacagacaacaccagatgcttgtgcttttctgtgagcagctcaggtctcccaaagtggtagtttcctggcttctggcctttgtagatcagtgtggatccacacccaattgtgatgtttgtggtagctgtaagaactttcccaattttgaaatcctaggtgacttgtagcatattttttcacatttgaaaataattgagttttgaaaatgtttttacaggcaatctagtatcagattttatatcatcctgaaacattctgtcaattgtcatttccaaaaatccatggaaaactggagttgttgaactggaaacagtgtggtctcaggaagtgcttcacagccattgcaacatgggcagggcctagagggcaggagagaatgccatgatttgatgacattttacccattcctgccaggtgaacttcatctccctctctgtgacagaattttctggctctcacatccagctttggtcactgggaacccacctattggctcttgcactggcaggacatgtggtagaggcttccagttcgaggcaggactggctgcattttcaagatgtccttatttctggtattttgtggcgatcgtcctgtccacttaactgattttgacccattgccttgctgtgatctctgtgctctctctgtctcccagttccaggtcattcccttgaccagcttccagtctttcctcatcttgtccctgccaatgaagtattctggctctgccttcactctcctgccatgatccattgctttgatagggtggcttcaggaacagggtgaggagagggctgtgctagctttatcttgccaaggaactcagcaaagaaaatttttgctgacctcttgcattcctcagcctggctctggtctctcaaacctaacacatgggatgcatgccagcagccagcctcagtttccctctggtccttttctgtgtgaggccagaggtccttgctttatcactgcctggagctgcagttgatgatggtgaaagaaggtgcacgtgtcttttgagagctccctttgttccccagagatttttttttcccaaagtggccatgagtttgggaataaccaggagccatgggccgccggctagagatgctgcatactaagagcctcctgtgagcagccatgtacacagtgaacacgatggctaaggccccatccagccgccctcaaagagcacatagtccactaaggaataagcatgatcgtaataaccattagcacctgctgtgtgctgagaatgtgcaggcactgttctgcatgccttatgtggactcactcatttaattctcacaccaactcaaggaggtgcttttattatggagaaactgaggcagatggaggttaagtaatttgctggcagttttgcagccaggaagtggcctaaccgagattagaatccagacagagatcagagcctgtactgttcatcgctgtggcatccatactgcccctccatttgtgataagcccaggaaggaaagaaaccaggtgctctgatggagaggggttagagcaaggatggttagggaaagcttttctatcgaggaggagacagttcggctgagacctgaaacatctggaggagcctgccttccaaagaacctggggagaggcattgtggacaaagaagatagggaggagggcctgaacaatgagccctgtgcttggagggtacggggtgaggtgagcagggggcaggagctgggccctgtagggtcttgtaggtgagggagaggaggctattgggagggctcctattgctcacattgcagtcctggggggatgcccagggcattttttcttttttttaagaggcggtgtttcactgtgttacccaggttgtttttgaattcctggcctcaagtgatcttcctgcctcagcttcccaagtagctccagggaatttctgttttaccttgcctcttcagttgcgccgtccccttcagtattctgctgacatggatcacaggataccagacacctggtagttgttcagtcagtaggaggtcttccttccttcctcttagaatcaatccttttctcacttgttggctctgcattttatcccccgtgtatcttttcagatttttgtggggcctcctctcccatccagtccaccttctccagtctctatggtatatttctttgtcatagggtgaagcaggaacaggtacaggatgattgggtacactgaggtgaggtaggagggcaggccctcaggaagggcttcccagaggaggtgatattgtctgcaaaggcatatgagagcctggaagtccaggggaactgcaggctggtctgtacggcttgagtggcacgtgatacagtttgagactatgaggcgagagagctaggcagatgctagaccatgattgttcttccctttccccactcttcaactagttgtaatcttaggcattggattctctggcaaggggacaatacccagtagcctgggccagatggaggcagccatatctggagtatgatctgagccacagcatgttggagaaaagccagaatcagcccagggcagtgtgcacccatagtgctggcctcaggcctttggagggtgagcagacttaagttggaaggtgcaaacaagtggtcagtggtgctgcccaacatcgtgccctgaactgcagttgacagctacggcagctttggtaatgaggctcatagcctgggggcaggcagagtgagagccgatattggcttggccagagaaaagcccttttgggctgccgaggaggttggattccaggccaagggccatatctggcagctgaagtgtggaggttcagaaaaacttcgacaccggtcagtttcccgcctctgctgggaatgaggtgcatctgactttcctcctcaatgatgcctaatttcatttggtcctctgccccttggccttgtgttctctagagagttccctgcagggtggcagaaggagctgatcctagtaagggaccgtcccatccagtgaggaggtgagctgggctgtgtcttccccttctgcaccctcctgactgtcacatccccgggagccccatgattccactctaactgagtgaatcacagaggccaaggcccttggctgcagtcaggagtactgagtggacactggaagattggggtcttgctactgactcacgatgtgacctgggacatgtctcaactcacctagcctgggtttgcttatctgtaaagtgagaagttccatttgttggtcttggaggaagcttcaagagcagtgctcaagggttaggctcagaaaagcctgtttgaccctggaaggtgtcagctcccaggttgacgtgcccacccctccctttatttctttcagggtgaggagcccctcgagctgcatggtcactgttactgtcactgccacatctgagcagcctcacatttatattccagcccccgcaagtgaattggactccagctctaccacgtaagaagggctatctagcaacctgggagatgttcctccgccacttcctccttggcggtaaaggacttggcttttgttccatgttgcttcccatttagtgccttccccagtttctagcaggccattagccaaggggccacacaggacagtgttagtcccctaatataaactcccatctaccgggcctagacattcccacacctcctttttcctatctctgtaagaggctgcagtggtacttcctagtgcactagtggatgtggctctgccattcatgggtccatgcctgggaagccagctccagtccgtgaaggccgggcctgtgagggcattcctgtgttactgtaaaggaatacctgaggctgggacatttataaaggaaagaggtttaattggctcacagtttggcaggctgcacaagcatggcaccagcagctgcttggcttctggcaaaggcctcgggaagcttataatcatggtggaagccgaagtgggagcaggaccatcacatggcacgagcaggaacaagagtgaggaaggggagggcccggactttgaaacaaccagatcttgtgtgaactaactgaatgagaactcacttttcactaaggggatggtgctagctgttcatgagggatccccccatgatcccgtcacctccctccaagccccacctccaacactgggaatcacatttcaacatgaggtttgtctgtctctgtcacatgcccactgcttcacctgcattcctggccacctgtcagggtgcaggaagggatgtcactgcaggaaggctgctcagtgaggtgtgtgtgttgggggcgggaggggggcatatccaagggggcctctgcagacatcaggtcagcaggctggagtgtgcagcatggaaatgggggaaaatttggggccatcctgagcccagcatgatgcagaccttgtttccagtcctgcagaggccagtccaggatgaggcaacctctaggcctctggactctaggagtgagaatggagaggttagatgtgaggtggagattgcacagtagctgagtaccttctgggaagtgctgagtggtaaagactgacagtgtaggattaaggcttggaggatatcttggttgtgggtagaggggaaagacgacgcagccctaaagtaggggtggaaagcccacaggactgaagtgtagaagtatagaagcctggggagaagatggggtcaccgaggtctgcatggaggaggacagcacattgtcattggttgcaggaagcccctttctggggccctcagtccaaacacaacaagagacgctcatggcctgggattgtagtctgagtccacagcagtgccagtgcctttatcctgggccttcccatgagctctttcacttccttcaaaccaggctgggtctccccagccctgaaccactcctgtgggccaggcctggttccctggaatcttctggtgtacctctgatttcttctgtgctccttctacagcaaagggattctcttcgtgaaggagtacgtgaatgctagtgaagtgtcttctgggaagccagtatctgcacgctatagcaagtaagagcgggtcccaaacccttccatgtcggccttctcctgccggctcccatattctcatccctgcatttccagttccttgtccaggacttggctcagagtagcttcggggtaattgtcgagtggatgagtgatgtagttgccctctgatgggattgatgcattttctactgaactgggcacctttgggttctcccttccggtgaattcatcctgcacaccattttcactgccattctgttctgcttgtctttgttattttattttgtaaaatgctgagaacacccctcttgacagagctggcagagccctagggaccaactagctcatcctatttcttttcagatcacagagctcttctcttctgccctcatgttcttttctgtcatgccaggctgcctcatttgaacacacatgtgactgcagttcctgatacatgtgtggctttgctttttaattttaattaattagttaattaattttaattaatttttttttgagatggagtcttgctctgttgcccaggctggagtgcagtggcgccatctcagctcaccacaacctctgcctcctgggttcaggcaattctcctgccttagcctccctagtagctgggattacaggcgcccaccaccatgcccagctagtttttgtattttagtagagatgaagtttcaccatgttggccaggctggtctcgaattcctgacctcaagcaatccacctgcctcggcctccccttttcattgatcatctcttcattttcttgctttgtgatgccatgtggaggggtacttccatgtcacctcggtgtattgctacctaccacactgaggtgaggtcccttagaatgtttcttatgacatgtcatctcactggaggattttagcaacagagaggagcatcctggccttatttcaggattgggcctctggggcttctggactggcttttattggtgctgtggaatgatgagcatggctgtgggggtcaagttcaagccccagctcaggcccccctgttaggatcacttcggacaagatgttcaacctctctgagctttgctttcacatctgtaggcccttagggtggtttttctcaacagcttattgagttataattcaccctttaaagtgtacagtcccgaggttttggtacattcacagagttatgcaaacatcattatccaattctggaacacctttgtctccccaaaaagaaactccaaacccgtctgcaccccctaattctaccccataactcaagcacaggtattataccagaatgatcccttctttcttctcattcccagtatctgatttctgctgagtgggctcctggtgactgtcacattatatcataggtggggaggaaagctctgctgttttcccactggtcagtggggtccccttggcatatacaacctcaggaatcctagccacccagccccgatcatctccctcattgtgaaaggtctcctttgcccccccatagaagggccctgtggcaccaagtcatgaatgacgactggcatcgtagttatgtctcagcttgtggccaaaggttaattagaaaattaactatgatagtgatttggctctcatctctgccctcctctcccctatcaaactccctgcagcgtcagcagcattgaggactcattcgccatggagaagaagcctccatgtggcagcactccatactctgagaggtatgttgactttcttagcacggagcttgcacttctacagaggagaatcagggaagggagagttcctgctgagtctgtttgcttttgtcttctgctttgcagcctccaatccatttgcagaaaggtgaaggacactaccgtagggtggtgcttcccttgttgggatatcacacttgtgacaactaaagcctttgaattgagctaagactagagggtagataccagcggtgactgagaagggaagtggtggcatctgacaacccagaggactcgtgtcagcaggaggggcccttcagattagaacctaatcaatcacttcattaacttgcaaatctaaccagaagtaaaaataaaatgactacaaaagagaggagtgggcagagaaggaagaaaaatgggctgctggcatcaagaagccagaaagacacacaaagccaagaatgcccagtgctgtggagccaccaaattgaaagcaggggcagagaacacctcgttcagcagttttgaaagctgtcactagatgatggcacagtcactagagagtcttaatgacaaagaaatcttatgttcagattcttggaatggggagaagagagtctcagagattgagttcactcaggcttctgtgaagaaaatggaataaatagccttcagtccacagtaagcaaatacggcagacccaggactaaaccccagggccctgactactcccaggttagggatgtttctactctgccatcttgcttctcattgatgggcagatcttaattcatgtggatgacattcagagaccaaagctacattggggaggaaaaggaaggaagtaagagggttaagataaagagaatcctaccgggccccagaggcaaacatataggagcagacaagcatatggggccagggaatctcctccactatagctgaagaagcaggtggttctgagtaactacagattacttggtgaggcacatcagcagatgaagtcttagcagagaagggcaggttggtcagaaacctgagagttaaccacttacataggagcaaatggaatgaggcttccaattctagtggagtgacaaaccagatactctagggacccccctttccattgcacaactactaaatccagaatcagtcattactgatccattgctaggcttggaggaaggaaggggactctctagggacaatctcagtcacttgcacacatgcatatgcacagacacacatgcacgcacacaaagaacagctgtgagctggtgctgctggtggtgaaagaagcaggaggagcagggctgcgctgagggcaaggatttcaagcagcactgctgtccagagtgaaccctgggccagcagcaggatggtgggccacacccaagctgcccgtgacacttctgggtcctccgacagagctaacgtggatctagattgttaatgtccccccgccccttgggcttctgtcagaagcagacccaaatctctggaagaaagtaccctgaattttggcttgtaggatcagatcaagcagttactttgaggaagtgcagtctgaggaagaaaagcagaggtgactctcagaaacaggcatcctggaactggaaagatgctcaacccaggagtcagtatctagaacttcagtgtcggatctgagtaggctctacagacagagcatgaagggtgggtccaggagtataggcaggggcagagctcagttggcccaggcgtgaggagaagggccatcaagacggggccaggcagggcacacaatgacatgtctcctgtaggagaaggcattggtcttcctgctctagagggtagcaggccccagcggataatctaagcagaaggtcagggggaggcaaactgtctggaataagtatcatatcaggacatctacaggagacatgtcattgtgagctggaaaaagatgcatgactagtttttggaaataatgcagaggtctacagcaggctgagaactgatctggcccagggctgtgctgcacaccacagaaaacagtggcatcctggggatcctgacagcaaacctgggcctggctgcaccaaattggaaggtctggctgtgtcacatcagaggtctgtacaccagcctgaccaccgggttattgttcttcatctcacaggacaactggagggatctgtacttactgcaaccgtgagatccgagactgtccaaagattaccctagaacatcttggtatctgctgccatgaatattgctttaaggtaaaaaagaggtggaagacaccttgagctaggcggtaactcctgatcacgtgctgctaagaacgttttgtagagtgcgggagtcttacgggttcagagactgtggaggaggcttgatctccatatacaattgcacatagtcgcagaggctttgcacaactgggagctgaatgagcttccaagtctaagacagtagatgagtgttggtggttctgcatgcttagtactgtagggaagacaaaagaggtcttttcaggaaagactatttctggcagagggccagcaagtgcaaaagccctggggcagaagcactagagtgttctagcttgcgtgggagaatgccaggagtgacagagtgggctagatcatgtaggccttggcgggcacagagtttggattttattctaagtgacattggggtccccattctccacagtgtgtggcactttgtaaccccaggttgttggttccaatccatttagggtgtcacctctgggtgcactgagaaaaacaaccctcccctttgccttgacagaatgttaggcaggcttctgtcctccccacagggcctgaactttgcttgctcctggttaagtaagtgctgcaatgcagaacatgccccacttagcagcttctcctgagaaccggctgaccacagggaaacacatttctggtcaaatcatgccaaacaggttcccctttgcttgcccactggcccttgaaagtagctgagctgctagctgtgcttactactccctactgaaaaaaaaggcttttttttgtattattttgtgatgttttttgtattattttgtgatgtttgcaagtcctgaggtccaggatgtgccacgggctcacagcatctgctcgcccaccttgttcaggcatccccttcccactccactcattcctcttgctttgctttgtgtgttgacctccagcttgcttttcttttcagtgtgggatttgcagtaaaccgatgggcgatctcctggatcagatcttcattcaccgtgacaccattcactgtgggaaatgctatgagaagctcttctaggtgggtgctggcactgcaaaggacaagtggccaagagactcattaaggagtagagatgcaccctggtctctcctggagtctcagccccagacacagctatctttcttggctcttccttatgttcagggggccttgtgtcctcatgtccctatgccttgtgatactttgagatcttaggtggcatggacaaaggccctcaatgaggacacttccaaatcacaccttccgtccagcacctgagccgagccctctagctaccctgggatactcgctcggccgctgttgttagccccattttgcaacaaggaaataaagatatagaaagggaggggacctggagaaacccaggtagaatcaggacctcaccccaggtctttggattcttgtccagggctctctgttcactgtcactcgcatagcttcagatcaggactgcatagccatggtgctcagtgaaacaagcctctgggccacattatgagaactgcctgaagatgtgtgtttgcatgctcatagccagtggaatttatcacggtgtctgagcacagagcagaatatatcccttgaaggcagtagcaaccaggctttccactagctccatgctgatggtcttctctccagaagacacaccttgagctaggtggtaactcctgatgactggagcagtcacccaccctgagggcctctagctgatgtgtttccagtctcatggctacttctgttttcttttagcgaccccccaccgccaggctgatcagaagctgatgactcgtggacaaatttggctgtccccagttttgccccaagttgctgtctccccttccctcacctcctccctccctgtttgatttcttcatgcttttgcccttctcaagttgaagttgcatacatccaatatcgtatcttaatgatgctatgataattgcttgtgtgtgtagcttcttgtagcttagaaagcgctttatgcccatgatgtcatttcaggctcaaccaaagaggatcaaacaggaattccatcttggcttccctaagacagattggctttctaatgagtttaagtgggcagaagtgtagggttcagtgtgtcctgactcccttgaggcttataatgggccaagttgaagactgttgatgatccctggtgggtaaattgcagacatcaaatgctagggattggcataggctagtgtttagcttgtctatttgccatatctattttttttaaatttccatacacttgtaaaagtagttagttgcttttgattgagttatatagcagtttttcatttggtcttccactcacctttcactatatttgagtgttcccttacaggtatgttggcatgtgttggaaaatttacacaattaggtttaaattcagtaggatgtgattttaggatgctactgatcaaagtgatatctgtgtctgttggaatcttgatagctgattaatttgccctcaattctgctccctgaacttcacacataaatcttcccaagtgggttttagggtgtatagatcccagcaggattaaggaggtggaaaagcagctaacatttcttgaggctctaccacatagcaggcactgtcacagagtaatggcattaatccccataataatcctgtgaaggtgatattctcatcccatcttagacatgaggatattggaactcagagaggtggctattgcattgcgcagaacgctacagagcccatgctcttcccagagcagcacccacaaaagcaagcattgattttgtgctcagtgtgtgccaagcactgtgcagagggtacacagttcctgccaggttaacaccctcccttcaggcctcccaaaggcataggcttgcaaagagcagaaggtgtgaaatcacactcttcctctgggcatcctggatccctgaattatccccccccccatgaagtacttcaagggccaagctgcccctttccctcctctccgcccatgaaaatgcctccaaactgagatgctttcagctgagaacagatttgactcacagacattaccaaagaggagcttgtgaatccaggaaaagctccagggggctagctgatctgagcagagagctttcagtgacccattttcctgtctagactctgccttaagctagtggcaactgctggggccccaggtacttgggacatggaaactcgttggatggctgggcagatgtaagcctgtccatgcagtcagccgatcctctgctcaggttcagctggactctgccatctgtgggcccagcatcactctgtaagttccttgaaaggaagaacaaccttagagtatttctgatacaaaatgagggcctctgctcttgatttaattataaaatgtctacgtctttctccagtttctgagccctatgcacattggcttgtgggcttgttcttcctgccaaatgatcagagaggaacattccatttatttgtagtggatttcctctggagggcatgtacccacactaaataccaactgctcttcctcagctgtagtccccaacatcagacttggcacgtggtggacactaacacacaggcactcaatgaatgagtgaaggaaataaaagtcaccccgttggtgagaggtgctatccctgagtctcagtgcaggaccagtggatgaaaggcaaggtaaagaggcccaagataggctggcttcccccgttcaaggtatagtctgcctttaagggagttttagaaccaacatgcaagacattgaaagaaatcttgcaagagccattattgacttagatccaaaacagcctctctcatgtctaaaaaggcacagaattttgcagatctgaggaagagggatgcattacctttttgcttcttttcaattgcttagtgtttctaatcatacttaatccacactaatgtgcgcaattataataaatggtaagatatcacatgtgtca

SEQ ID NO: 180 - DNA, 3432 bp, Homo sapiens
gttcaaactgagaaaggttttacttttaagacaaaacaaatagcattaacacacatccaaatgccagtgcaggagttcactgggtttataaaagagaaaactaaactcaagtgtcaaataaaaactggagccgtcaagaatgactgcttgtggcaacacaggtgtaacatgtgcttgtctaaagtcgttctgtgtttgtggatatgtggaaatgcatgacgagggaaacgatgcaaggcaaaatggcaggtgctcaaagctttaagatccttttcttcacgcttgtgtgctcttgttttgcttttgagaattagggtaattcgcaggtcattttacaaagaactgtaatatcaaagaacacttccaaacggctaaaataggctcaaggtcactattaaagtgataaagggaggtccgtgggggaaaagtttgtgttctcaaaagccagatttcacaccatggcaggcactaaatctagttacatgtgcttgcagtagaaaaagaagacactgatcttaatagaggctggtctttttcatgatgcgcaggaactcttgctcactgacctctccatctccatctcgatcagcttcatcaatcatttcctatatgacagtaaagattcaggttaatttataaactaatgccaaaaggtgactaagtaatagacttttttttttttagagatggggtctctatgctgcccacactggtctcaaattcctggccacaagagatcctcctgcctcagcctcccaaagtactgggattatatgcatgatccactgtgcctggcaagcaatagacttttaatctatgtgaatagataatttgtatctatgtgaatagatcattgtagtccacccaatgccagtatgctactcctgataatagcttggtttctgaaaagttatttgaaaaccaactcatactttgtcaaacatatcacctgggagggaccttgaagattgccttgactagagggattcctggaacctaaaatagtaagcaaaattgtgcatatgtgcatttttctggaagcagggttcataggtttgtctgactattaaaggagaattaagttgtctgcagagggacaaagtacactggcttttcttcaaagaggtgctcacactagggaaaatgtaatggaaaagtcacagagggctcaaaggtgggaattttaagttccagtgtgatgcattacaaacctgcagctcctcatcagtcaggttctcacccaactccttggccacgcgtttcagatttttgaacgaaatcttcccagtttcatcatcatcaaagagcttgaaagctttcaggatttcttctttagtatctttctcagacttaacaagtagaacataaaacacatgagtagggggacaccacggttggttactactgtcctgtagccctgccactgcctggtcaggtcaccctttcctttttaacaatgtaactcgagtctagacttgcggcaagtgtcaggaagcccattttggcctcaaagaaacaccaggcaagccaggcactccatccaaggtgacgtttgctacctatcgctatatctctccctatcccatatctatttcctaactgatttggaattctgtgggaagaggtatctgcttggaagtcttgagaaagaagcacaagggcttgttttgggagcccaaagtaacatgatgggagggcaggcctcctgatgcagttgctacctggactgctctgtggtcacatgactgttttaacaggaagacgccatggacctctgcagatgactggggctccataccatgataattgtcttagctacttaccattttctgggtcatcacagttaaaaagtcaccaaagttcatttttcctgtcccttccttatcaatttcacttatcattttcttaatttcttctttcttgggttcaaagcccagggccctcattgccacctataaagaaaacaggatcgtctcaataagcacatctaaagtagcaggagcaaaaataacagtgttgagagcattaagccagcatctgatgtggtcatgttaatatgattggggaacactatgacattgatctaattgatatttgcaatcaattttattgaataatactcaaagtaagtaaagacaggaaaacagcacagtacaacctcccctgttacttactgcagggagaagagggcaaaaggggtagagaggtgatagggagatgacaaggaagaggcagaggaaaggaagggcagtacggcaggaatgcacagagcttgccttcagttctttaacatctatggtgccagttccatccgcatcgaaaagatcaaaagcttcccggatctcctgcttttgctcttcagtaagctcaggcttagggctcattctttttcgctgagaacttgatgccatgtttgccttcttaaagttggaggcctttatatgttatgcaatacacaagcacaataatatatcatacagtccatatttacataacatagttacagacacccatatgtatttttaaagtcatttatataaccaattccaaagctttgcttaaaaagaaagataacagggtttactggcaagaacaatgaatctttccatgaacttctacccctcccttttctttactgttgtttctagaagcagggagatcacttgttcagtaaggacacctcttactgaaaatcatcccaaaagagagccagtcaagaagatgactgtgaataactagagataatcagctcttcccgaacgtggggatcctggttctgaaaacagtcttacgatgcccactcccagtactccccttcccagtaagtactccgacttcccaattacttctagatttggccaaatattagtaagttgttaagatgtatattgtgtcagtaccgagtaataaaactcaatccatctggcaccttcgtgccttctccaagaagctaaagcatcccctgaatgcccctgtatttaaattgtaaaaaacattgtaacagaacacgatacaccttttcccagctgtgtgtggaaattttggcagaatgaggaggccagggggccaaggtctgagagagtcaggggcctgtgagggattcgagtcttttttgcccagggaggttcaccgaggggatcagggaatgcaaggggagcccgaggggcgggtgtgggcctgttgtgggtgaagaggaggcagcagcgaagcgcaggcccagtaggttggttagcgtctgtaccctactctcccgggaaagagctcaaaggaaagactggtgcgctaaagccgagaaaggcgcaggagaggcggcgtggccgagctggggcctgggaagggctcagccgctgggcgtggggcgcgacagagcggcagcactcaccatagccaaaggagtccgctgccggttgttaggcaaccgacgtgtacact

SEQ ID NO: 181 - DNA, 59041 bp, Homo sapiens; identical to SEQ ID NO: 174

SEQ ID NO: 182 - DNA, 38398 bp, Homo sapiens; identical to SEQ ID NO: 173

SEQ ID NO: 183 - DNA, 363315 bp, Homo sapiens
tttctgcgtttctctagtgcagtgcctggagatgaccaccaaacggaaaatcatcggccgtctggtgccatgccgatgtttccgaggtgaagaagaaatcatctcagttttagattactcccactgcagtcttcagcaggtgccaaaggaggtctttaacttcgaacgaacattagaggagctttatctagatgccaatcaaattgaagaactacccaaggtaacttttgacaacctaaaatatacaatgtaaatgagtatttcataattttcaaatactttattataatggtaatgtgaactatgggctcctatctaggtaactgacaagtcattgaaattgatataacttcccccaatattctcattaccttttaatgttactccatttatgatttcacgggcctctgttaataacaaattgagctctatggaaaccaccatttgatggattatgcctcgttatcttcatttaaaatgacctctataaaaatatagagtagagggttgagatcaatagtttatgtttagaaagaaaggaaaaatatgacactactccagaactgaaaatttctatgttgtatattaaggtgacattatattacaaccttgaattgtatgctgtaagtctaagaaatgcttttacacacattaatgctattatgaaaaacatgtttttgtacctgtatgtaaaatatttgattattacaagtagcactggatgtatgtggcataaaactagtaaaaagtttactaggaatttgaaactatcaaactttgtgcacatacacacacacacacacacacacgtgcacacctgcacacacacacactgccattatggcattgtgccatgcaaagaaaaccaggtctcctgtgaccttagtccttattgcagaaaagactggatgataagagattagctaaagcagaccaagaccacacagcagagaagttcaaaatctaaatcaagggatcctaacagtcacctaagtaagtaacccagattaagtagttagcatggtatttacctgtgaaggatttatacggctgagaagggaaaaaaacgtcatgcactcaatttctgttgcttatgctaaaaagtaaaaatgtatattaaatatgcagtaatcagaaaaagaatcttccacaataaaaacttgaaattaattatcagaatctgatatttcaatatgctgatcaaaataaattatgaataattatttttatttaaagttataaattatcatttgccggccttttggctaagatcaaatgtagaattataaattgtgctgtttacataacacttcaaagttaagaactttttaacatgtacttcaaaaacaatatacttcatttttgacaatctgtgtattgtgtcatctgggatatttccttagatgacactatacacaggtatagtgtattttttagaggtaggtcaggcctataaaaaatattattgactacatggattcacactaggattgcacatcaactaaagcctggagtgaaatagactgtctgttgtaccagatgaggaactacttaagggcaaagatggcaccgtattcatctctgtttcctggtacatgggcaggcatgatgaatttcacataatagatactgagtctctgttgtccctgactgagagaacaatgcagagaacttcatatgccacaggacttgattagcaaaagtatataagtttgcataagtcataaatgtggtaacccattctaatttaggaaaataggcatggggggtggcgggtttctaggtcaggccaatctaggattgccagaaagaaatagaggacacccagttatattttacttttaaattcagaaacagacaacatttttgtaaaattatgtcccaaattttgtatgggatacatttacactaaaaaaattttttttatttacatgatgttcaaatttaacttatcatcctgtatttttatttgctaaatctagcaaccctaggccaatctggtcattttaaatctttttccatttctatgcaacaaattttgtaagataggtagtaaaaacatggttaatttatcaagcaagtatttatttaatatccattctactacacagtacttgaagctttagggaggttacaagagaaataaatctcgatctctgcccttccggatctgacaacctaattacagagaaaaactgaagcattagaggcaagtgctcggtgatgtataatcggagccaaagagccaagtaccattgtagagcgtatgtatagagaagagctccatttttggagaagtaagggaagaacttgaccaaaaagcacagatggaaaatttaagatgcatcaagagttgaagggagcagagttgtgaagagtctggaactgcaggtgcatggatgtggatgggggcaatatgtagggagactgggggaggactcaggttatgaaagttcttgaaagtcacatagtattgtttggcttaatgcattgataagataattccattgaaaagtcttatacatcaaggaactcactaggatcctaagtaggcttggaagagaaattttaagatattttgtctgtttggttagttaaaataattgactaacaataattaaaaataatataagtacaccaaagacttaatatattttaccagtgcattatagttaaggagaatttattatcctttatcattgacctgccttatatatttcaaagaaattttacataatctttaaaggtttctgtgagtttcaaggttgaattttttttactttcataaaacagccatgtaagctagtttcccttaaagtatctgatatattgaaatatgatctaatgatctgatattgaggtatgatccaaacagtacatagatgtatttgtgcattataggaaaaaaataggaaatacaaaaatgaaaggaataatgcatcagagttcattatatgtgtttcaagtaacagaaaacccaatacaaactgactttacaaagaaataggtttgattggctctcgtaagtggtaggtccatctcaggacagtaatcagaattgatgggtttctattcaccttggcaggaacaaatttattccgaagctgacttttctcatggtagcaggatggctgcagtagttctagagttcacctccacagcatccaaaaacagaaacatctgactccttaaaactctttctgagaaggacaaaatatgtctcccctaaaattcttcaactaatttgtctgcagatctcattggcgttaattgtgtcacatgtttactgctgatgtaattcctttgctatctgagtacagaattagctactataagaaaagtgggattactgtaattgggctaaataataacgggtcacctctgtagagttgtggctgctggtagcagtacaaggggaaggggtggaaagggtaaaatggctgttgcagagataaccataatgtgcactataaagaaactgctataaaataattatttcaggaggaaaaatgcctcaaaatcaaaaactatgtataaagtttttaatggcctataggcagagcattgagctctttaaggatttaaatctttaaagttagattaaataaaaattatttttgtctgccattttattttatggttttctttgagttgttattcagatttgttgagtaataagatagccatttttattcttgatattacatcaagtaagaattatcttttacatatgtatctattctttgctttctgatattgtacacagagaatattataattggtcatgaatctctactataagatgttatgtaatacaatgggtagagaacaaaaagtcaaggtaaaaggcattagggaagatatatcaagagtgtgtcagaaaagatacaataatagatatgaaagaacaggaagtattttgattaggaatagttcaatctgtgtgtcttgattttctgtagtgaaaggtaaaaatacaaaatgacatgcctttcacacagtgatagaaatccacgcagcttataatttagtactgttttgcttgttattttgaattaggaacttaaaattatagacagagtaatagaccataacaggtgcatattatatatgaagtagtgtgggatggcaaatttgaaaaaaagcaataaagagaaaaactgccaaaaaaacttcttgaaactgaagaactttaaaaaagagattataattaattttggaaaagccaacatatgactaaaattgaaagacctggagagtgaatttggtagatgaaatcaatttagctacatgtaaaagagatgagactaaattttaagcaccatactttcaacattttctcggcttaaaagtttacaacccactccaaaaatattttagagatcaagaaccaaagcttttgacccaggcaaatctggaattatatcctagcattggtatttggttagaaaagtattcttcctggaaacctgtttcttcattagtaaaactcgggaagtaacaacactgtctcctgtgggtgggtaggtggatagataggtaggtagatagatagacagatagatagatagatagatagatagatagatagatagatagatagatagacagacagacagatagataactgggcaagatgatgtcagtggaatacctggaatagaaaaatattcagtaactggtatttattattctattacagctgaaataagatttccatgttaatttaccctgaatcaaagaaaagtaagattatgtaacatctcaggatagttctagtgttgactattcgacaaaaaatattgtggcatgacattctctttatctgaaatcttcaaagacgtcttctaggaaaacattccctggtccataaaatgtgatagggttctgaccctacacacttacatcaacacatttgtgataataccactacttccccagagaattttcttgactcacacaataacaatattacattatttttattagaagcaaccctggagattatttaatttagtccccaatttttactgatacgtaagtccaaagggaaaagttaattgactttccttaggccacatggcatgttagagtcctatccaaaattattaccaaagactatgtattaggaaaggagaggttatgctgcagtaaaaacaaatcagaatctcagtggataactgaacagaaattttgctttttgtccattagtgctggcagggaccactgctcttcacgagcccatcctaacaagtagttcaactttccacccaatgcagaatcatatgcttattatttctcttgcaatggtcacccaagctctttgtgaatatttttagcaatggaaaaaaatcactaatttaaaggatagaccattatattactggaaagttctaatttttagaaaactctgtaatacgttaatgatgtttgcctatttccatccatctatctatccattcaacacttggctaggagctcagggtgatacaaattattaaggtatgccttcactgaacaagaaactatgcattcatcgtcactgtcttaatccttcaaatatttttaaaaactcaggtacttgcttaagggttctcctttctaagacaagtttccaacttctcttgactatttttcagacattctatctagactcctaaccatcatagttactttcttctgcacagattgcagttgttagcttggttttagatattgcattatcaaataaaaatatttatccaagtgaaagtactccaaaaagcaataaacaaaatgtaatcaaactcaggagaggagtcatagttggagacagatatttaacagtcatcctttcaagaagtgagttaaaatcaacagaccaaaaaaaaaaaaatgtccttagaaaggaaaaagacaattgcagagaaaaaaatattaaacttagaaagtgaaatgatagtataaactcactgctggaacttgcccagaagttatttgtgtttcccccagcagtcatgacaacttcgcatacagaggcaaaattgggaaattttattacgctcatgaagccaaaaaatctctccatggatgagaggaatgcaacatcccaactgattttgatctgggtttctataacttataaaacctatttgctctaatgaacagaagacaaagagagcaatttactgtgtaacactttcaaagctaattctagatattttcaatcctctaagacatttgaaatttaaggtcttgctcatttcacttatagagatcacacattaactgttttgtgtctgaagggtgaagttcttgcttcctatcagagtgccataaaacactcagagtggatacaacattagtgagatgtagaaaagttatacagatattttaaagtaattagcaggaaaaccaagctatgtattcttaatacttactcatttcctggaggcacgttgatggtgtcttcatttgatgctgcttttacctcagcatgacgcagatcagttgatcccaggcttctggattgaaaaatccagcaaactgtgtgaactaacattctctttcttttgctaagtaaacatttttaaaacactcatatatgatttttattatttaattgtaaatgctttcacacccaaatgtagaaaacaatcataagcacaaaacaaatggcaggcttctacaagaaaaaataggtagtaaacttacactgtctttttttcttaaaagttttgtcgagatgcaatttacattccatcaaattcagttttacaaattcagttgttattttcacagaattgcacagccgtcatcactgtctaattctagaacattttcatcaccctttgagaaaccgcccatatctattagcagtcactccatgttccctgtttctcctcgcccctggcaacttatttctccatcaatttgccgatttcagaaatttcatataaacagaattacatagcatgggtccttttgtgactgtcttttcactgagcatcatgttttcagggttcatccatgccatagcatgtgtcggtacttcattcctttttattgacaaataatgttcctttgtatgattataccgtatgtcatttttttaaaaaatagaatataacacttttataaatgcagaaaatttgttataaaatgttatttttatattacacatatgtgtaactattttcttaatacaaatccatcagtttggagctttatagtctttcgtatacataaagttgaactccaatacccaaattcctccagtatttagggttttgttttttatttttatttatttattttttaaaagacaagagtctcactctgtcgcacagtctggcatgcagtggcacagtcatagcttactgcactctcaaactcctgggctcaagtgatcctccctcatcagcctcctgagtatctggaactacaggtgtgtgccacgatgcccagataattttttatagagaagtggtactatgttcttcgttatgtatattgtacaagctgttctcaaactcctagcctcaagtgatcctactgcgttggcctcccaaagtgctggatttacagacatgagccaccgtgcctagccaatccagtattttgttttaattaggcactggttgaaattcaatttcataaaagtatgcagtgaaaatgaaggtaaatttttaacaatattacactcaatatagaatattgtcagtaagctgagaggtgccagaaaaaaacagcctccatatatctacagttgcttgccctaggtgagggaaaaaaaaacagacattaagaagccacatccaggtgagggctgcaggaagacagctgtatggtgctcactactccacgccggccactcatgctgggctttgtagctgaaacaccgatcattcaatataaagcagtcagggatttatcacaaaggtgttttaggctggtgaaaattttgtcatgggctggcttcagtcactggcccatgaaatagcagaaatcctccccaactctttagaaaataaatgaacaacaaaaatgcatctgagtcatgccagctagagctccatgttcatgactggtaaatgggctctgacaactgtgctggagcagtttggccacatgaatgccaaacaggctttctcctcggagactttacccttggtttttccactgccaggcttgctctgcccctggcttgctcctttgtttccttcagatctctgctcaaacatcactggagaagcttttccccattatctcatacaaaataacaacacccactatcaccaccacttattcagcctggacaaaattttaagcctcattgtgtctctaagagatatctcatacaacttgattgtgttaaccagtattaagatactgcctaactactttatcattgccataaaacatcactgtaaatatctccctctgatatgctgtctattattttacaaggaatgagagctttgacagtggccataggtaaggaaggaaggggaaagttagagcatatctgcatatgcataaaacacagaaaatataactctctcgtagcagtttttacatttttgatgctgatcctgggagttgggatgacatgggatagtttatgtgattcctctataagccaggacctaatacaacacactgtttgcatttttccttcctcccaaactcttagtacttttatccatataaattagagttgtcacataatgtttgctcaaataaaggaatgtgctgtttgagtctaagagcagtcaagatgtcatggaatgtgcttttatgtttggggatgtggggtggaataggttttctaaaattctttccaaacaatattttgtgattcactagtataagcttctttttaaatagacaaaaataaccaacaatagaaggaagcattctgacaaacagcatagtaactatagttaccagttattatcacagatgtactacagtacaatgtaaagaattctggtgaaagaggacctaggttttaacacaagttctgccactaattagtcatgtgacttcagacatattgtttaactcctttgagccttagcatcttcatttgcagtagttgctcatctagatttgttcttgcccatctcctacaattgtggtgatgatcaaataatataaagtatgtgaaagtaatttaaaaagagcaaagtaatctacaggttgagcatccctaatctgaaaatctgaaatctgaaatgctccaaaatctgaaactttttgagcacagacataatattacaattagaaaatttcacacctgatctcatatgacaggtcatagtcaaaacttagttccatgcacaaaaattattttaaaatattgtataaaattaccttcaggttatgtgtataaagtgtatatgaagcataaatgaattttgtgtttagactctggtcccatcctcaagatatctcattatgtatatgcaagtattccaaaatctgaaaagaaaattgaaatccaaaacactctggttccaagtataagggatatttaacatgtataactgttgagttaagagaaatggcttattttaataagaaacaagagttgtttagtgaagttgttttgcatatttaaaataaagacaaatataacactaaaataacagaaagttcttttagttgcttaatcaatggctatagattactatttaatatggatttacagttgtgtcagttagtttttttttattgtaggccagaaaaaccaactggccattttaggtaaagatgaacacttactagaaagatatccaggctcatagaactaataggggcctaaagaactttacatggaaaaaggacaggaaccaagagagttctagactgctgctcagaattcacagaacagtgatggtctgggccacacaatgctgattttctgaggatggcaatttacaaagacctccatgtaaccgtgacagttgttcaagattcaaattcctgctgcctccacaatgtacaatgagggatgtcattaaaaggaagatcaaggttctaatgcaacaaggggaaatggatatctgacaagcaaaataaacaaaaataaagcatcctctaatattctacatattatatgctttcaatcgatgcttcgtttcattcactgatatttgtaacttaagatgtattagttcaaggccatgtttttcttaaaactttaagtaaaattatttgaaaacaaggacacttatttattttgtgtgaggtctaatgagatcaaaggagccatggaagaaagattttagggtgacaaattttgaaatgctatttcatggttgtgattgtagtttctcaaaacttgaatgatcattgattattttttttcctcctacttaaaaaggaatcttttgaaatgaaaaaactacttgtatcactataattgctgcttaaacagttgtcatgattgagaatatgaaatgtgttgctcgagatttaacacagcctaaacttgcaaatgtagaacaaaaaaattgccacttgtttaataaagttgccccattttaaaatttcatgttaacactaattcccttaagggtttgtctttcataaacaaggaatgttctgtagccttggcataagtagccccacatatatctatggagggctctccttagatcctgggtttgaataaaggtctaaaaaatgaccttttaaaatgtctcactttctcaccaatgattttgtgcatgattctatcctccagtagaaaacttagattcacctgacgtaagtcatgtatccactcttcgattaatgtttccagaaatacaagaacctataactaacaaggctgcatgattttgtcccccagcgccaaatgtatacaatttttctgaatatataaaactacatccaggacaaaactatctcatatatatgcatatgtgatacataaatgatcaaaatttgactctgtttaatctctttcctaaagcatctttttttccatatatgttctttaattgcaattattttggcatttaaatgaatgccattatttctttcaataaataaataatgtagattaactctctaaagccccaaggaagagtgagatgaaggacatgaagattagcaaaaacatagtttgcatgtggaaaatagtaaataatttttgcttactcagattttagtttttgcttaaaatgttttattatttaaaaatttatagtaccagcaactcttaattatgtgagtcaatgagaaactgacatctgtagtatcccagtcattttttgagcagttttataatcttctacaagtttataatgagtaagatgacttactcatgccatcatttatttctaacatttacccaaatatcaaatatcattaaaatctgattcaacaacaaatttgctgatttttcctgccaatttttgagaaatgatacaaaaaactcaagattttaggtaaaatatatcaattgatttgtttgttcattcagcaagcatttcttgattaccaattatgtgcaagcattgttctaggtgccagagatatattattgaggaagatcaacaaatttctattctcacaaaatctaccttgctccaaaaggagcatgtaaatcaacaaacaatttaaaataaaagtgttaggtgatggcaaacgccattatgaaaataaagcaggggtccaggcacggtggctcacacctgcaatcccagcactttgggatgccgaggatggcagatcacctgaagtcaagagatcaagaccagcctggccaacatgatgaaaccccatctctcctaaaaatacaaaaaattagccaggcatgatggcggtgcctgcaatgccagctactcaggaggctgaggcaggagaatcgcttgaacccaggaggtggaggctgcagtgagctgaaatcgcgccactgcattccagcctgggcaacaagagtgaaactccgcctctaaataaataaataagaaaaaagaaagaaaaagaaaataaaataaaggaggggaattgctgagagggtacttgaggtggaaagtgcagtaaatgcctaaaaaatgatcttttgtgttgagttctgaatgacagcgaggggtcaaccatgcaagatcatgcaagatcagagaaagaaccttctaggcaaaggggacactctaaggagtgtggcatatttacaggacaggaagaaggagggtgtgtaaagaatgaagggaagagtggtacaaggcaccacagaagaggcaggtgggagaggttgcaggagaaagactggggctaaatcacacaagttcaaataagctaagaatggtcttaagattttattctaagtgacatgaagggacactgaagaattctaagagaaacaatgacatgaaattacttttattttaaaaataccactctggctgcagtggaaatacattgtagcaagtcaagagcagagacagagattagaggctattgcagttgttcaggtgagaggttggtggcttcaactagactgacaatagtgaagaaaagaatttcagactatgttttgtaggcaaagttaacaaaatttgataatgaaatggatttgggagataggagattaggatcagaaaggaaatttagaaagagttgctattgatagaggaggaaaacaaggaaagaagggtttttgaagatacaggaagaaaatttatgttgtcatgaaagccaagaaaagaacagaaagtgtttgaaaaagagggagtataaactgagagattggctaagaggatagaggagagaccattgtatttgctagtacggaagtcgttggttaccttaataagagtagtacagtgaaaacctgattgaagtctattaaagagacaatggtgaatataaacatctctacttaaaatgttttgttgttagggaaagcagaaacatgggaccagctagaaaagtgtatgaggtcaaaatacattttattttaagatcagtgacctgaaggcacatttgttcatgactagaattaaataagaagaaagggggagaaactagatgcaggaaattgatggaataattataggaccaaagtcctgaaggcaaaaggacaggagatcctcagaatgcatgaaggggaggaatagatgtacttcattcattgtaatgaaatgaaatgaaagagaaagaagaaaatatgggtgcagatgatgatggttgggaggacttgagggacatgatagacactgaagtttgttcaaaccatagaggttccagtgtgtgaaagaaatgctgtgagctgaaaggacgggaagtgacaaactgagagggtgagagagtggggtacatgaaatttgggattaaagaggaatatcacttataaaaggaattaagggccttaaatgtataaattaactgtattttataaagtttcttttaaagtggtgggtagttgagaaacagatatcaaaggcaagttctcctaaagtctcctttattggcttatatgcctggaccagaagaaaccgaaaagacagatgaacagctaagaaggcaggaaatgcaacaaaagtttactgatcatctgctctgtgctaatcacttcatatgcaatagcttttctgtcctcaaaacaaccctgcccaataggttttgttatcttcactaaatttaaggaccttaaagcacaacgaggttaaagaatgtactaaagggtatacaactagaaaatagagctgggcatggtggattgcacttgttatccctgctactggggaggctgaggcaggaggattgcttgagcccaagagttcaagactgcagcaagctatgatcacacctctacagcctgagagacagagtgataactgattttactggattggccatcttgatactggggaaaggagcaaaatgggtcacaggtgacccctaggtttctgctacaggatatctgtggaagcaaaaagaagggaggcatagaatccagggaccagggcccagttcagaagagcaataaaggaatatcttacaaagccaggtgggcatcaccttgagagagcaatcttcccatgctgcagccggctatacagggcacaggagtgaattggtctagaataaaatgtagacctaccaatttatccgatgtgctttacatttagaaatataattgcttgacatttgacagagctttttgagcatttggagaaaattaaggataaatgtttagaaaaacaagctaaaaaatgaagcaacttcaggaacaaaaaaaaacttttatgagtagcatatacataggatgaacaaatctagaaatctaatgtacagcatgaggactataggtaataaaactgtactgtatatgaaattgatgcttaatgagtagattttagctactcttgccacagaaacaaagaaaagtgaggtgatttatatgttaatttgcttcactacagtagcctttttgctatctatgtgtattctgtaacatcatgttacatactttaaatatacatattacatttatgtttaaaaaaacttttatgagtaaagcaaacacagggaacaaatccacattattaatgtcagcatttactactgatttaaccgaagatttggatgtaagtatgctgggaagattaggaaaaaaactgatggtggctttggtggtgagagatgatatgatttttcaagtgccataatatgaaataaatacacgatctctacaattgatagaaaaagacaaagaaatacacgcacatctttagaaatgtagaagaaaatacaagaagtaatagctaaaagagttgaaagaaactatctctggaagagagattgcgggatgtgaagaagaggaaaaagaactgagatatttttatttaaaaaagtttaaagagaaaaatagaattgagctagaagagaaaaacacagggattagttctttggtagagctgatcaaatttgacaatataatagcacttccttttgaaaatgatttatcaatgcgtcttataaaagccacactaataaaaatatatgtccagggcgcaagtatattataaaacatgatttgagcaaataaggtaaaaagtaaaaatgtaatttcattaaggtgtttcaatttctgctatctgttcttttcactacttcttttaatagttgttacttggttattgaatgttttaatattattcatttccagcttattagtatatgacttgacagtttgttatactctagagaattaatcccctgtcaactccgaaaggctgatttcattctagaagtgagtccaaattgccacattagtggaatgccctctctgatttagaaccactttgagatccaattcttgaccaggcactcttagaaagtcaggccactcttaacttgttacagaaatgtaggattacttcatagagattatgaagctgaccttgcatagaactgacttctagtcacatgtaaaattcatatatagacatttgctttcaaaaattaggagagctatataaggccaggagtcaggatctactatagcaaatatgtactgcgtctttctataatgacaattaattaaatgatttctaagagagaaccataaatatgttacagaatcaaatgcgaaattcatctgaattgtgaagattaaaaatcatatttactgtattctgttgttagagatactgtggcagaaaagtttaagagaccctggactagacttcagagaaaatgagcagttccccagattatgagaaatgatgggaaagaaaagaagcaaaggatatgaataatgtaagctcacccttattgcctcctagccagcattatttaatttcaaaggtcagctccaaaatcccaatagagcctctaattacagagacaaagagcagcccaaagtgaaaagtctggggtagggaaaaccactaaagtcttagagttgggcagacttaagtttgaatcccagcttggggaaggttctcagcctcagtttctctcctatgtaaactggagaatatagcatctaccttgaaagattgtcttactcctatcttatttttatcatctactgaccctgtggtaattcttcttcacgttatatattatataacataatatatgtgaaatgtgagtatggtgtctgcaaaacataacctttcaacaaatgacggtaattgctatgagctacaatacagtaaagaatacaaaaaagctggcctctccctataaaatgagaaatgatagttgcactttccagaaaggaagttatcttctattccaaattaacagtgatataaaatgaaataaatcttttgcagatgttttttcttccaaaatgtatgtggaaattaattttaataaaatcctagagatatgtatcccttctatgcatagaggcaatttgttgtttctataacgaacctgaaacagcactaagagagttaagaccagtcagagattagaggaaacaacaatattctacctctttctttagaaccattttactgcttcttggtttcctggtaataatgcaacctcactaacttgctattgatttttcattttggggtgtgtgtgggtgtgtgtgtgggtgggtgtgtctgtgtgtgatatttactgcttcttgctttcctggtaacaatgcaacctcactaccttgctattgatttttcattttggtgtggatctgtgtgggtgtgtgggtctgtgtgggtgtgtgggtttgatatttattgctcagacagttaagtttctgtttctttaaattttaagtggatgaattaaaggtttttttcctattttttgagattctttatggtgaatttcccatggccctcaatggagtcttccctgtgtgtgagtgaccttaaataggattgaattttagctttctaccaagagccctaaataattaagagctgactgataaaagcttgtagtatatgtttattcattaatattaatgatatttccttctgtcatcaccaatggaacactgccagcagcctacctacagaggaaccctaacacttgggaggaatggggcagatcccgggcccacagaggcagggtatgcgggatgccaacagcaggaggaactctttttagaagaatgaaatcagggatgtcagagtggagtgttctcagaagggagggatgacattgttaaatggaatagggaggccaagaaaggcaagaactgtataatccattcgaccaggcaataaagtgtcatttgtatcttttacaatgcctacttcaggggagcaaaggggaaagctccttgatcttgcttttctctctgggttatcaccttcatctattctcatattctcagtgccacagtgaagactcacaaagctacgatgccagctcagcccagtctctcagtcttcaaacttgtacatgcttgctggacttacttgaatattcacactcagcaagtgtaatttcccccttgaaacctatctcctgtcctgtattacctgtttcagttggtgactattcagtttggataccaagacagtcatcatttactctttctatttgttcagcttccacatcaaatcaacagccaagattttgttacctaaatatgccttaaatctatctcacctctccatcctatgactgaagcctgtgtcagaccttcatctcacagctgactaatggaatagtctccttgctgttaccttaaaccagccttttcccccattctattcctcacacagccaacagtgacccattccaaatataaatatgaccagactgtaacctaagttaaggaagttacctgtctcttctctaacttcaggggaaaaaaccatgcagcttagcatggaatgctgacatgaggcctctatagtctggctacagcctatttctgcaatctcttccttcttctgctctcttaggaagtgttcctgaaacacaaagcttttcttgcctgtaggttcatgctgtttcctctgcctggcatgctactttgattcatctcaactgtcacttcctcccacagccttcattattcactccctggcacatttgttccactctcctctgtgcctccatattaccatgtatacaattccatagttgtacttgccaaacctgtggcaattattcattctctatatgtttattgaatgcttactctgttccagggaaacaaaggtggagaagaaagacactaatgtgtgtctgcctcccctaccagaatactaaactatgtctatttaatctttgtttccatgggaactagtgcagtgtttagtccaaagctagcttttcactaaatatttattgcataaatacttataattttgtaacagtgggttatagaaatatatatgcaagagtatatgaaaacacagtagagagacaaccaatcctgctttgcttggggatcagggaggtccacctggcagaagtgcattgctgaagacaagactagagcacaatctaattgggtttttagattagaaatggaaccttagagaacatggaactagctcaataatgtggctaagtatgaatggagtcagaattcaaatcctggtctatctgattccaaagtttataatctactgattagcactaccagtggagaaaatctccagttataccatgagccatcttctctctggctcactgaccttggcagagctagtcagcaaagttaggccttttgtcactcatgactgatcagggcatagaatggcaaaaacaaatatatacacacacatacacacacacacatatatatatacacacacatacacacacacactcatatatatacacatatatacacacacacaaacatatatatatatatacacacacactcatatatatacacatatatacacacacacaaacatatatatatatacacacacacacacacagatacatacacaaaccagcttacactagtatggaactttagattaatgccattcaggctaattgttcacataccacattgattaccctctatagacaaagccagtagttttttatatgtcaactaacaaaaattttaccaaccaataattactaaaaaagcaacaaaaggaacccccttcaaaggcacacctatgaacaagcatgctcatccacacatatcctttataatttaccttaatagagacatcaggaatttaccccaaatacccagaaacaatgaagctgggttgaaattaagaacatttaaagctatgcttttaaattcagctttcacatttttctatttcattgtggatattattagcttgctaccatcacataaagtaatcaaggatatgtaagttaaataacattttcatttaaatattttaatgcaaattattattgaatacagtagatatggcaatgtgctatgccttgtatattcaaagcaacagctgttattccaataaaacagatatattcccttccttctaagacaatggcaaacattaaaataaccttcctcttccaaagggaaaaatgattcaacaacatctttgtacaaactgttgtttaaaagatctgtattttaaaaacaacagcagtgatatttattgttttctaggataaaatccctaggtatctattgtagtcacaatctttctgcaggaaataaaagagctcttctctgcagcacattcagcattgttaaaatgtactagaaaggactataattgttcccttttcctgtagctccaatgttacttgatactaccagcacctgtccagtactatacctgtcccaccaaccctacaccatcactactactaggcacactaaagtcttgtttgactacaaaatcttctcttctttgcccaagcactgctggcaccaactcttaatgatttctcctcttagctgtgtcactctgctcacttctactaacagtgctttcatgaagactcattatttttcatctggatgttttctaatctcccacctgcctgtctgttcataggtgccaaatgtttctcaaaaacaaaaatctgagtaagtcacttcgttgcatatgaatatttaaggggtagatgttagtgtgggagagtaacatagaatagttttaaaagcacacaattccacgtatttaaattctctacatcaaggaaaaaagtctagggatatttctttgggaataaaatgttctttgcaaagccatctctctgctatagtatttattacattgaattttatttataaccattagttagctgtatacgtgaggaaggggattctttgttattcatctttgaatcctggcactgtgcctgtcactgagtagatgtccaagaggtgctcactgaacacaagcagtctagggggaagggaaaggatagaagggaggaagaaagggaaaaggagagataaagggagggagaaaagaagcagggaaaggaagggtaaatgatgtcacaattggaagcttacaatttcaccaagtatgtatataaaaccatttttactctcttattacttagagttggctcttttctaacaaaaaaaattattaacacttgttttaaacaaaggaaattttaaaatattttattataatgtgcacagtataattatttctttgaaacaactttcaaatgaactgaacatctttaaaggaattcaaaggaagaacttctaagaaaccagccattcagtgaggccaactcactagacaaccatttcttttccctggtgaaatctacatgtgcctacatatggcatcaataagcctctcactgaatatttatgatttaatataaagcttttcaggaaaaggatttatcttttgaaaattcgcacacaactaatacttttgtatttgtggtgaaaaactatccagctaattttattttttctaagaaactaaactatgtttgagatatagtcatctacatttatgccatttttataatgttcttaattttccaagcatgagtataaggatgttaataaaatgctaatccaaattatgatttttgcatttatttggcactttgctaacccaaagtgctataacatatactcgtatttactctaagctcctctctgtcagtagatagttgttgagtctgagtcttctgtaattcttctggggcctgcggcctttgtgagggctcactggatccttgtcttatccactctcccctcccagaaagcctgtgagagactgttgtcagttctcaccattatctttccaaagctcagatctgatcattcagaggcgatagtgcgctagtatagaaatggctttgtggctgggcatggtgtctcttgcctgtaatcccagcactttgggagatcgaggcaggcagatcacttgaggtcaggaggtcgagactaggctgaccatcatggtgaagtcccgtctgtaccaaaaatataaaaaattagccaggtgtggtgtgcacaactgtaatcccagctacttggcaggctgaggcaggagaatcgcttgaacctgggaggtggaggttgcagtgagctgagatcatgccactgcactccagcctgggagacagagcaagactgtctcaaaaaaaagaagaaagaaagaaagaaagaaagaaagaaagaaagaaagaaagaaagagagagagagagagagagagagagagagagaaagaaagaaagaaagaaagaaaggaaggaaggaaggaaggaaggaaggaaggaaggaaggaaggaaggaaggaaggaagggagagaaagaaagagaaggaaggaaggaagaaagaaaaggaaggaaggaagggaaagaaagaaaaagaagaaagaaagaaagaaagaaagaaagagaaaagaaaagaaagaaagaaagaaaaagaaagaaagagaaatggctttgtacccacacagaactgattttgaatcttagctctggcacttgctagcaatatgaccttgtaaaagttacctcctgagatttctcatctacaaaataaggataataataccttatttacaacattgttgtaagtagagacaatatacatcaaagtgtagtttaatcacttgcacctatgtaataggcacacacaaaaatggtgactatcttgctattatgccactctcctacatagaatattcaagaaagaataaccacttactgagaaggtacaatgtgccaagcattgtgttccacactttccgtactgcaggaactggagaaactacactacaatcttgtaatcacaaaactcagacatccatgtttcaataggtataaccgtacagaacactacaaaagtatgcaggtggagcatgtaaacaggtcttaatctgtgatctggaacttgaacaacagagtagaggggaggtgggatagggtggagtggaaaagagctccagctggagactggtatttgtaaagtcaaggcagagtacacaggtgcagaaacacagctgctgagtgtggctggagatgtggtaatgcaggacagcagaggagaggtatggatggagaagggccagggaaaagggaaatggcaagatgagaaattggagaggcgaagagccttgaaagccacattaaggaatttggactgtcctgaagagagcagacaactactgaaaaattatgaggaggagatggacctaatcatatttgcttttttagaaggaacatgccatcacttcctttctcagtggccattaacctagccaacagatccatgcctgggcttcaggtggtttgcaagttccctgaaattggttgcaaatgtgtgtatttgtgtgtgtggatgcatgcacatgtgcatatgtgtgttctcataaacatttttctggagatagcaactaaaaggttaactcaaaattgtgaaaaatgaccatccaaacacttcctacaggataaagctcagacccttacagccttttacattctaactaaaacccacatttttcattcctctccacacagcttacaatacagccacttgctttttgttgttgttgccattctgaatatgcttctgagcctttctttcatgtacagcctcttgggcttttctgcaccttccaatcttccctacctccccatccccaccttctactcagaaaacaacccctctctgtaaacatggttgaagtgtttcttccttctccaggcattctctcatatttctttcccattttttaagaaaagcacaaatcgaagtcatagaattctggtgacccagctagagtgagagagggatagacaaatagaccagtaggctagaaatagaaagtccagaaactaacccacacttaagtggaaataggatatacaaaaaggttgtcttgcaaaccagtggagaaataatgaagttttaaaaaatgatcctggaggccgggcgcagtggctcacaactgtaatcccagcactttgggaggccgaggcaggcagatcacctgaggtcaggagttcaagagcagcaacatggcggaaccctgtctctactaaaaatacaaaaaattagccaggtgtggtggcgagcgtctataatcccagctacccaggaggctgaggctggagaattgcttgaatctgggaggaggaggttgcagtgagccgagatcacgccactgcactccagcctggacgacagagctagactccccatctcaaaaaaaaaaaaaaaaaaaaaaaagattctggaataactggtcatctataagtggaaaagaataaatccttacttcatatcattctcaaaaataaatttcagataggtccaatcaaagcattaaaacatttagaagaaaaataaataattttagtcttcaacttttgtgtatgtgcactagcagatgtatattagaatattcttagcagcattgctcatgttagaaaaaaatgagaaagagcccaaaagccatgaacaatagaacatataagaaagtcgtgttatatgaaacataaagcagtgaaagtgaatgaatacattttatacattaacattgaatactattaataacataatatcaaatgaaaaaggaaagttgcaggtggaaatatacagtattactccatccatataaagataaacacacaaatccaaacaatatataattttaagattattaaacctgttgtaaaagcataaacagaagcgagggaattagtaaaataaaattcaagaaattggttgcctctcagtggtggtgggtagaagacaaagggatatgatagagaggagcataggtgaactttcttcaactggattgagaaatatgggtcttagttttattatagttaaaaaatacatattacatacgctcttgggtctgtgtatttcacaataagacattttaaaagacacaaacaataataaaataaatacaatgactcacaaaagacatggttcctctccttgaggagctcacagtttgatgcttgcttcagttcctgtgtcctccttgttccatagattgttgtgaagggctcctttcttaactgttgtctcccttctacatcctttgggtttattctgttaccttttgttgttaattttcttaagtcgcatgcttaactcattcattttcagccttttgtcttctctaatgtaagcatttaaggctacacatttactacctattattctggctatatcgtggcatttctattatgtaacattttattatttaattgttttgtaatctccattatcatttattctttggtgcatgagttattaaattttagtttgtaaatgtagaacacaatataaatgtttttaaagttattttttagttacaaatttttaacttaattgcattattgaccaagaaactggtctttttgttatgaattctctggtgtttgttgagacttcctttatgtctagcacatgatcaactgtaaatttttatatgcatttttaaaaaatactgtgtagtaattgagctcagtgttctatatgtgtcctgtagaacaagctcattaattgtagccattagttcttctatagctttttgtatttttgtctgttttttagtcaattattgaaaaatgtgttaaatatcctgctatgataacagttttataatatctccttgaagatccatcaaatgttcctttaaatatattaatgttactatactaggtacatttataattgttatacattcctggtaaactgaagtgattatcattatatgatcactctctctctagtaatgtattttgccttaaatcagtattgctgtgtaaactttcttttagttaattttgacagttttacaactttgcatcaagttttgggtgcaccactgttaaacaacatagagattgcttgtttttaattttaatccattctgacagtctgtttcttaattggagaaattaatccatttttactgaaggcaatcattgatgcatttgtattaatgtatttcactctattctgtatttttatctgtgttgctacttctgagtcttttttcattatatttatcaaagtcttttccacttctttatctcattccatttattttgtctctatcaactagaaatcatacactttatttctattttttaatttgttattctagaaatgtaaacataccactttaacttaacttgaatatttaactttgatctaaagttaatcagtatctttgccttcctcccaaacaatgaaaaaatctgaaaatgtttgtaatataatataataataatccgaatatgagtgccttccaacaattctgaaattcctccactacctcactcattttattttctacggtttcccaaaattccaaaaagaccttcttaccgtgtcctccatgtcatttaagcagtcttttaaatcctacttttatttctttaaacatattaagtgcatttattttacattttaagtttcataattccattatatccaccatttgcaggcttgattctttgtttttctgtaacatctcactcaagtcaattattttattatatatttagtgatttttttaaatgatgttatgtttcttgcagtgttatctatgagacaaaggcctaaatttaaagttgagttccttagaggagacttgtatgcttctacctggcacttggggcaatactaacacaggaccacttataactctcaagtgggtttaaagaagccccataaatactgtgaattccagtctctaacacaagagagctcagtcttgtggttggcaattcctagaagacttttttttctctctctctctgtctttttattattttttcttccttcttcctttccttccctctctcccttcattcctttgctattcctttctgtcctccattctttcccttcctttcctttttttcttctttttcatccctcttattttttcttctttcacttcctccctgtattagtctattttcatactgctgataaagacatacccatgactgggcaatttacaaaagaaagaggtttgttggacttatggttctacgtggctggggagtcctcatgatcatgatggaaggtaaaaggcacatctcacatgctggcagacaagagaagagcttgttcagggaaactcccctttttaaaatcatcagatcttgtgagatttattcaatcacaaaaacaacacaggaaagactatgatttaattacctcccactgggtccctctaacaacacgtgggaattatgggagctacaagatgagatttgggtggggatacagccaaaccatatcattctgcccctgtactctcccagatcttacgtactcacatttcaaaaccaatcatgcctccccaacagtccctcaaagtcttaactcatttcagcattaactcaaaagtccacagtacaaagtctcatctgagacaagacaagtcccttccacctatgagcctgtaaaatcaaaagcaagttagttacttcctagatacaatgggagtacaggcactgggtaaatacagccattccaaatagaagaaattggccaaaacaaaggggccacaggccccgtgcaagtccaaaatcttaaagctccaaaatgatctcctttgactccatgtctcacatccaggtcacgctgttgcaagaggtgggctcccacagccttgggcagctctgcacttgtggcctcgcagggtacggcccccctcccagctgctttcatgggctgtcattgagtgtctgcagcttttccaggcacatggtgcaagctctcagaggatctaccattctggggtctgggggatggtggccctcttctcacagctccactagggggtgcccaaggagggactctgtgtgggagctccgaccccacatttcccctctgcactgccctcgcagagattctccatgagggccctgcccctgcagcaaacatctgcctgggtatccaggcattttcatacatcttctgaaatctactcagaggttcacaaaccccaattttggacttctgtgtacttgcaggctcaacaccaagtggaagctgccaaggcttggggcttgcaccctctgaagccatggcctgagctctatgttggcccctttctgcacatagcacggggccctgggcctgtggtgggagaggctgccgcaaaggtctccgacatgccctgaagacactttccccattgctttggtgactaactttcagctcctcattatttatgcaaatttctgcagccaacttaaaagacttgcccccatgattcaattacctcccaccgggtccctcccacaatatgtgagaattgtgggagccacaggatgagatttgggtggggacacagccagactatatcactccctttcttcattctttttcttttctttattccttcttccccctccctccatccctcctgcctgccttccttccttctttcctccttccttcctcccttccttcttttcttcctttttcactcttcactcaaagccaaggctgagaaatacatgtatcccctgctaaatccctttgcagacccagtttttttctagttcactcactgggggtggtctctaagccaatctcccactctgttcagagtccaagcagtcttctatccttccacttgcaatatctgtaactcaggcttaacccatcaaggaccaacagactccaccagaacaaaagctaaatccagactcatgtaagtctatgtgttatttttcttgttattctggaattcaaataattgcctcaaattacaatcagagctcattttatacaataaagcagtgagtgagtgtgagggtgtttagttttgctgtaccaaaagattactctttaaatatttagttcaccatacttctgaaacagaagttgatttcttttcatacctttatctttagtgctgaagacaaatcatagcacataatagatattcaataaatatattttagatgcgtatagatgttgtagactcataccattcactccaagattcaagtctcctcatgttgtcaagcaaatatctgaaactagcttgagctacgtattctttgagttgagattatctttagatgtttcaacaaaggtgtgacattattgcctctttagccttcatctggctatcttctgattgctctctcgtgtccattttttcacacctttcctagagatacttccataaatcaactccagcaccatcaacaataaaatctggtacagatatcctacctgtgcattttcattacaactgatatttaccccaacataaatttcaattaaattaattaaaacttaaacatctgaataataaagcacattaatgcctgaacatgaaaatatattaatgtctgaatattaaagtataaagaatctgggctcaagtatagttgtttccccgcacttagcatagtgtctagcttgtagcaagtatcaataaatggtttttcatgaacaaatgaatgaatgaatgaaatattttggaatatacattttttagctccaaatgtatttttattttcaacttttgaggcttttttctttttgtcagctcttagagaagacatctaactgctgtgtttcagttctaaatgtttactttggtgtcagtaatttatattgtatagtcttctcaaaccaatttcttcagagttaaattgcttcctttagcccaagaaaaaagaacactttagtacccaaatattttaagacttgaaacaattttattgtttttgaaatgtaaaataccattagcaaatgaagacaggataaccatgcctttaattcaattcaagtctttgagaatcattgagtttaccatgtgaccactaacagttttactctaattataatagctatcaattatatttgccatattctactatattgaagaattacatgtattttataatcattcctcattttaattcaaagctttcgaatcttgaaagagctgttaaaatgcctttttaatttctttgccaatttgtattcttcataattatattaagaagttcactgttttatatttgaaacttagattccactgagactgtttacctattgaagttcccaatccagtgaactaccactcttagctggaatatagcactctctttatttcccttttaattagctatgcagaatttcaaaaatatttcttcagtatgtactatgtataagacactgtaccagtcacttttgtgtatagaaagaagaaacaggttgataccaacatggatcagccatgattcctgcctccgtcatctagaaaagtaaaaaataaattattatataggtgtgcctctgtatctggtacataaatattaataatggcttacagttttcatgctttactgtgtgacaaacaacgtcttacattttcacaagtaccttatttcatcaaatattcaaggccattgattataagacacatccatattgtagtgccattaaggaagaaaaaaagactccttaaaaatcataacttactcctgactgcagggtgcattccaaatatcaaagatgttaatatgtgaaaatatgtgtgacttagaactgatgaatctattaactcaaataacactctcaacaactcttcaagttaggtaatgtattgttctcattttataggcaaggaaactgatgagttcaaagatattacgtaacttgcccaagattgcacagctagtaaatagatgggtgaaggttgaacacacttcaatctgattccacataccatattcttagcttctccaccaaggagatcttggattcttttgttacaggctgttcagaagtttctgtgtcttttctttctgatgtgacttcatttaaagttgaaaaagaatactgggactattaattcttgagctcacttcagaatttagttgggatgatgagaaaaatttataaaacaaacaaattgtgttttgaagatcattagcctgaacatggcttgaaatggttatataatagtgatcagactagagagttgttagtaaatcttaccaaaatcattcataagacaattgctttttttaagtctatgaatctgtaactgaccacactgtatgcagatatagatgtaatagttgtaacagaatgatagagactggaataagtataaattaacttataccaggagtgtaggcatctgttttcctatttatttagaaggaaaattaatagtagaaactatccatcaaagtatgcatctgagttctctttttgaggtttcatacaaagaaatagcaacatttatatctaagatattgacaattaattctacactacatgaagtgttacgaatagtctttgtaaggcaccaaacatgacccaaagtaagaaactgcatatttcatattaagtaacaaccagcccaatttattttttaaaggctaatgagttaagacataacgaccatgtgctacattgtttttgcctgtaaataacgaattacatgggagaacaaatggtagttaaatgtactgtaggccagtttcatagtcatggataccagacttcatctgtggaaattcagcaaaacagaattagaaatgtcaaacagaaaagatctcattaagataattcttccagaaatgaatcaaaaattctgtcccagatgttcatatctggcaggagtcaagatgaattggacagagctaaaccatctaatttattgtttctcaaaatatgatactgcaaacacctgtatcaaagtttccagatcaccggtgtgcttgttaaaaatgcagatttttgacccccttacaggacctatttgggtaaagctcaataattcacactttaaagaagcatctacctcaaccagtgaatataagcatgctggatttcacagctattactttaacacttggctctttcccacctaatactttggactgatggcagaaatgaagcaattacgagtgatttttttcaccaaatatcagaggttaaatgtctcatgcaccaaatatttatgaagcagttgggggagggagcacaaaagaaatgtgaactcaagtattccagtttattgcagtttttgcatatttgataaacaactgttcaatgtgattacattaaaataatacctcatgaaatctaatgtggtcacagaaaaagagaactgaggtaatcctggtagctgtcagaatagaaaagaagggacaactccagaagttacttaaaagaaaaagcagtcagtgggggattcagtggtaaattgaatgagagtggtaaaagaaggggcaaaatagaatatcttgggtttgagtctgggtagccaaaaatagaggcactaacatgggaatagaatgtgaagccattcagaaacaattgagaagatgagtatggagggaagtgaggcttttataactggctcttttactactacatatataaacatggtgactttaattttgttactgagtttatgaatgaatttaaccaaattgagatctaattaatgattattttctattacagcaattgttcaactgtcaagctctacgaaaactaagtattcctgataacgacctttcaaatctgccaaccactattgctagtttagttaatcttaaagaactcgacatcagtaaaaatggtaagatttttctctcatcataaaatacctagaattttttaactgaaaatgtgctttaatatcttctcttagcaaataatctaaaataactttttctttgattttgttgcaactgtagtttaatgctcttgtaaagttaaatcctaaattttaagtccaagacagacgtcctgtctctcctcctcttactaatgtgcttgactcgttcaagtcttgtttccctctgcattcagacatgtgatctaatcttttctagaatcgtttactgccctcacaaagctgacctctctcattctcagagtaacattttttctcaacatgtgtcaaatatcacctgcataacaaggcctacctgttcaccctatttgaaaatatactcttaatttcccttactgggcttcagttttttcccctagcactaaccatcctcacaatattgtatactttacctatttcctatggttatggtatattttctcctaactgagaatgtaaactccaattcataacaggaagaatttttctttgttttggtcactaatgtgtcccaaacatctagagcaatgcctaataaataataggaatttagtagtttttgttgtatttctggacagacttgtatatctggtgtttttgttgatgatgatgctgatgttgatattcaggttgattattttttctcctgagtatttatgggagtgacttagagcttcagaaagtctcttgcatccttgttcattcattaaatcttcatttctttccaaatgaactcagctctcccttttattagcaaggatcagtcaaaaagggttatgtctaggtacaatgaggatataaaataggaccccttcatcattaagatagtcagttaaacttcctgtgtgtgcaccgtatctgcacaagtagtgctttggttatttatttggttatatttagtgctgaggagacaggaatgcaggcatgaacaaaacagatcctgcccttctgaagtttacgttcaagtgggttgcccattaaacaagaaattgtagatgattaaataagcaattttgtgtgaagatgcattcaacatgaagggcatgcctagagaaggatgcaatccaatctttgtagttagggaaggttttcctaagaagtgataaccagataggaccaaaagaagctagataagattggcttgacatcctgggaaataaggatctgttttgtgaaaggccatcagaaaaatatcttggtcacatgtaaatataaatttcctaagaaatttggtgcctttagagctccatgacaatatctcagtagccttgtctctgttcatttgaccagaactctcctccacaaatatctgcaatgctcatttccttatcaccttcaggccttttcttaaatgtactgtcaaagaagcattcccagaccaccctatttaaaaataagatactgatattattattcaatagaagcacattttactcttttttttttcttatatgaaaaactgacccactgtgtatttaaattatttatctattgtctggaatctccttactagaattaaaattcagtgatgccctgaattttttgttgttcttttgtttactgctgtatttccattgcctaaaacagcgtgtgtcacattttaggagcccagtaaatatctattcaatgaattcataaatgaatgattgttccaaaacatggaaaacttgttgaaatttaccagtgtgaagtgctagtgattttcttaattcaagtctttgagagtaattgagaagttaatagaatcactgtggataagactgacactctcaaataatcagtgaaaattataaaatactatacaatgaagtacctaattataaagcacatgttacaatgataaattcttagacaatggtggattaattaagactgctgtattattagggaagagttcaagtaaaagatgttccctgaagattttcatgaaacactgtagcatctgaataaagagagtatttcatctgaaggagacaatcagaacataaacaggggacacggacctctttctacaccaacttgacttgccacttagaaggttttcaggaagagttcaagtaaaacatgtttcctgaagatttccatgaaatctgaataaagagagtatttcatctgaaagagacaattagaacataaacaggggacacagacctctttctacaccaacttgacttgccacttagagggttttcagcaagacaattctaaaagtaccatacacagatgtgtaaagagaagaacaactaggttttgacccatggaaagatgaccttagggctaccatgctttgagaatagatttacctatttgtatagatttgtatttctgtacaataaaacaattactactacctctttatttatatacattcacacttcaaattgtatttttgttataatttctgagaaatagtatatggacaattatcacattccttgattttcaggcaggattagctggatattccaagtaaagaaaaatctaccttatttttaaagaagatctgaaaataatttgtcacccaatataaacatgaaactcctaaataatttgacatttttgtgagcatgtaaaagtttctgatggctctcttacatcaagaaatgtttgctcttagaaggtgaaccacaggttatattttttcaactcagaagtatctgtaagcatccttagaagtttttgcaactattacctcggggcttttagctatgcttatgattctgtattttctggaaatatttatgcaaaaagtcatgcaaaagatggcgaaccactctgcaatactagtatagtactataggcttgatgagtataatgatagcagccattgctagaacttacacaaacagtaagatttcatcacatcagccatttcagaaagccatacctaagaaagctgtcactgcctggcgcagtgactcatgcctgtaatcccagcactttgagaggcccgggccaggggatcgtgaggtcgggagtttgagaccagccaggccaacatggtgaaaccccgtcttgactaaaaatataaaaattagctggatgtggtggcacatgcctgtaatcccagctactcaggaggttgaggcaggagaattgcttgaacctgggaggcggaggttgcagtgagatcacgccactgcactctagcctggacgacagagcaagacaccgtctcgaaaaaaaaaaaaaagctatcactgattctgtgacagaaaactagacagttacttaaggaacataatacatcctttgggaatctgtcaagtgaagaaagagtagatagcaaaaaataactgcagtgtcagaatcacagttgacaaggttggaatagccctgctgaaaaagaggcaagacctgagagaatacaagcagtattggtatttagggacaggacataatagactattttgaaacagagactcattcaaatattagtcaatctaggttaaaattacctaaaatgtgcttaaattagatgagtgaccccttaaagaaattaattcactctaaggtcaagattcaatctgatcttgattgttgatgtggcctcctacctttatttttcatgtccaattctactgcctgtcatcctgatccaccatttttcctctctataattcaaaaatactattttatattaacacctttagataagtgaactattgtgtacagaaagatatctgcacaatttgagtaaacagattttttttgggtttttttttgtttttttcttattttgtttttcctaaatgtattctttctattttattattattatactttaagttttagggtacatgtgcacaacgtgcaggttttgttacatatgtatgcatgtgccatgttggtgtgctgcacccgttaactcatcatttagcattaggtatatttcccaatgctatccctcccccctcccccctccccccacccctcaacagtccctggtgtgtgatgttccccttcctgtgtccatgtgttctcattgttcaattcccacctatgagtgagaacatgtagtgtttggttttttgtccttgcaatagtttgctgagaatgatggtttccagtttcatccatgtccctacaaaggacatgactctaaccacaactccagctggtcatctctcttccatttcatgctcagatagtaccagattgtaatttccaaatgcatcaagctggttgcttgtgacacaaggaatcatattatcttcttatcttctctacccaaaataccccttcctccctactgctgtaccccatcaaccagacagagtcctcttcacctttaaaaagacatttcagtcaggtgcagtggctcacgcctgtaatcccagtactttgggaggccgaggtgggcggatcacctgaggtcgggagttcgagaccagcctagccaacatggagaagccctgcctctactaaaaatacaacaagaagaaaaattagccaggcatggtggcacacgcctataatcccatctacttgggaggctgaggcaggagaatcgcttgaacctaggaggcggaggttgcggtgagccgagattgtaccattgcactccagcctgggcaacaagagcgaaactccatctcaaaaaaaaaacaaaaaacaacaacaacaaaaaacagacatttcagatgtcatttactctaggaaacttccctgacactgtatacataaggagaattaattccttcttcctctgtgatacttttttacattgtatatgtttttgttttgaacttatttcactttttaatttaatttctatatatttgactagattgtgagacccttgagattagaagctatctcatttatttctctgtttggaactactagcacaatacccagtatacatggtaggcattcatcaaatgtttggcaggtaaataagaattatatagagacattcttttaaaaatatataatgtgtatttaattacattagggacccaacataggataaggtcgccatccaattgttttaaccgagtgctggaaaagatagaaatgacactccgataagtaatgagtagccactaaagtcagctctaaagtgccatataataatacatttaatggttttgttccttagaataatgactacctcatatcaagttttggcctttcccctgagcttcagactagaataacaaacttcattttgggcatcactatatttattccacaaacactcccaatataaagtattgaaacccaaattcatcattctctccaacctgcttttttcctccattgtccagttctctgttaatgttactatgatctactcaggtttccaaagcaaaaattcattctcttcttcaacttccatatccatttagtcttcaactcctgccaaatttacctcctaaatatatggcaggtctttttccttcttactgttcccattgttacattcataaactagtcccatatctctttcctagattacttgatagcctcctaactggtctcatctccattattgccaccacaattaccaaacccattctccacaaaatagctttagcactctttcataattgctaatatgactgcattactctccaatataagatatgtcatttgaactagggtagaatgtagagttcctaacacagaattaaaagtacccgcaattgacctctattaactcctacattccatctgccaatcccaccacacatgatttgcactttgttttttttgtttgtttgtttgtttgttttttgagacggagtcttgctctgtcacccaggctggagtgcaatggcatgatcttggctcactgcaacctctgcctctcaggttcaagagattctcctgcctcagcctcctgagtagctgggattacaggcgcctgtcaacacgcccagctaatttttgtatttttagtagagatgggatttcaccatgttggtcaggctggtctcgaactcctgaccttgtaatctgccctcctcggcctcccaaagtgctgggattacaggcatgagccaccgcgcctggctgatttgcattttttaactttatggcctagatactgaagagcttcctcaaatagtgaatcttggtgactctatttacattatttcctctttcctctgactaaatcattttttacacctctttttacctggttcaatcgtacttattattcaaaactcaattcagttgttattgtttccatgtggcctctgacctgactaaattaagttaagggtctcccctctgtactaatacaccctgtgtattgtctatcctaacacttaatattgtattaaaaatgcttgatagctacattaaaatatttatgcacctttaatttttaaactattttaacattttaagtatgaagataataacatgagacaccaatgtacccatcatggaaattaaagtgttaatgtgtattatagatttcatactttaggggttttattagtaaataaaaggttagagaaacttgtaaatgctcatctcaatcccttcccacttcctccctctcagatttaatgtctttaaaatttcagtgaagtgctaccacattgtatatattattcttcaagtttttcattctatattttctaagatttgcctttggtgttagttataccagaaaattaccaatgtccccattgccccatatctgtgtcacacacagggttactaaatatattaattgttggccaatcagatggctatataagagtagcttcatgctttatatttccctaatcactagtgaagttggcattttttttctttttttgtttttgttggctagtttagagtctctttctttacagttgtctctttgggttcattttaattttgaatgcttgtcttttaggtttttggtgacttgaaagatttatatactctgaatgctagttttttttttttttttgattatgtgggctacaaatattgtctcccaatttgtggcttgtcttcactttgggatgccatttgtcataaagaagttgccaatttatttttaaattttatttgtatacctttaagggatacaactgttttgttaggtgcatacaatgcatagtggtaaattctgggcttttagtataaccatcatccaaataatgtacattgtactcattaagtaatttctcatccttttccccacaaccgaccttaccacccttctgagtcttctatgtctattaatccacactttatgtccatgtgtacacactgtttagcttctgcttataagccagaacatgcaatatttgactttctgtctctgagttgttttacttaagataatggcctccacttccatccatgttgcagcaaaagacatgattgcattcttttttgaattgcagactaatattccattgtatttgtgtgctacattttctttatccattcatttattgatggacacataggttgatttcaaattttgctatagtttgcaaatattttctcacattctgcagactttctgttcactctgttgattatttatttgactgtacagaggctttttagtttaattgtctcaatgtctctttttggttttgttaattgtgctttagagcacaaaatctcaaaaggtcttaagtcatgaattatttgcctagttcaatgtccagacgtgttttctctggattttcttctagtatttttatagtttcatgtttacatttaagtctttaatacattttgagttgatttccatatatggtgagagatagggtgagtttcattcttctgcatatggcgatccagttttcccagcagcatttattgaagagggtgtcctttccccagtgtatgtttttgtcaactttgtcaaagatccattggcaaagatatgtcacattatctctgacttttcgattctattccattgatatctgcattgatttttatacaagtaccatgttgtttttgtaactatagccttgtagtataatttgggggtcaggtaatttgatgtttccagctttgttctttctgctcagaaatgttttgactatttaggctctcttttagttccacgtgaattttaggattggttttcccaattctgtgaaaaacggcatgcatattttcatgtggattgcattgagtctatagattgctttggtcagtatggtcatttcaacaatattaattcttccaatccaagggagtggaatgttttcccatttctttgggtcatctacaatttgtttcaccagtgtattgtagttttctttgtacagatattccacctccatggttaaatagatcccaaggcattttattcatttgcagctattgtaaatgggattgctttcctgatttgtttctcagcttgttattggcgtacagaaatgctattgattttttgcacattaattttgtatcccgaaattttgctgaattcctttttcaaatctaagcattttttgaggagtctttagggttttctaggtataagatcacatcaatagtaaacagagatcatttcactttcccttttccagcttgaatgctttttatttctttctcttggttgaatactctggctaggacttctaatactatattgaagagagtagtgaaagtgggcattcttgtctttcagtttttacagggattgctttcagctactcccaattcattgtggtgttggctgtgggtttgtagtatatgatctttatttttttcaggtatgttctttctatgcctagtttgttgagggtttctatcatgaagggatactgcattttgtcaaatgctttttctctatctattgagatgatcatatggtttttgtttttacttttgtttatgtaataaattgcatttattgatatgcctattttgaaccatcttcacacactttgaataaaaccaacttgatctttttgatgtgctattggattttgtttactagtattttgttgagaatttttgcatctatgttcacaaggatattgatctatagttttattgtcgtgtccttgtctggctttggtatcaggataatacttgctttctagaatgaattatggagaattccttcctcctcaagtttttggaactgtttcatgaggattggtaccagttcttctttgtaggtttggaagaatttggctctgaatccatctggtcctgggattttatttttggggagatgccttattactgattctatctcaccactcatcattgatctgttcaggatttctatgtattcctggttcaatattcggaggttgtatgtttctaggaattcattcatttcctctggaattcttagcctgtgagcaaagacttattcatggtagtctctgattatcttttgtatttccgtggcatcagttatcatgtctccttttttatttctgattgtgtttatttggatcttttctctccttttcttgattagtctagctcgtagtctatcaattttgtttatcttttaaagtaccaacttttaatttcattgattgtattgtttttgttgttgttctcagtatcttttagttctgctctgattttttttatttcttttcttgtgctgtgtatttggtttgcctttgttttctagtttcttgggatgagactggaagttagtctgtgacctttctatttttttttttaatgtaagcatttaatactataaacttccctccctcttagtactacttttactgtattccgtaagttttggtaggttgtgtctccattttcattcatttcaaaatttttttttctaatttttgtcttaatttcattattgaccaaacattgttcaggggtatattgtttaatttccatttatttgtggttttgagagttttccttggtattgatttctagttttattccgctgtagtctgagaatatacttaatatgatttcactttttttaaatttattgagacttgttttatggcctgtcatatggtctatctatattggagaatactccatgtgctgatgagaggaatatatattctgctgttgttaaatcaaatgttctgtatgtctattaggcccatttggtctaaagtccaatttaagtccactgtttctttgttgattttctattttcaataatctaagtgttgtgagtgaggtgttgaagtcccccactattattgtattgcatctatatcttttttaggtctagtaatgtttgttttataaatctgggcgctccagtggtgagtgcatatatttttagaattattacatcttcttctataattgattcctttattatataatgacatgtttctcttttgttttcactgtttttgattaaagtctgttttatctgacataagtatagctactcctactctcttttagtttccatttgtatagaatatcttttctcatccctttaccttcagtttgtaagtgtctttgcttaccagtaaggtgaatttcttataagcagcatatagttaattcatgttgcttaatccatactactaatctatgtcttttaaaggaacatttgattcatttatatccaagattaatattgatttgtgaggttgtttttcctgttgtaatgtttttatctggttttgtggttctttgtttctctcaatgtagtaaaacatattactctttattgcataattttacaaattatttaagaaaatcttccctactctaatatcacaaagatatttttctatgttttcttctaaaactgtttgtttttcttttcacatttggatatttaattcatttgcagtttatttctatgctctatatgatcaaaatttatcttttcccatgtgaatagatgactgattgtttcaacaacattgtgtagtcctttgtttcccccactgacttgtaattctacctcttttatatacaaaaagcttttccccaaactattcatcctgctccattgccttatttgccgattcctgtgctattacaacattgttctaatcactataatctaatattcagtcttaatatctgaaaatacaagtccacttttttttggttttcattttcaaaagtgttttgccattcttaatactgaattcttccgcaagaatattaggttcaacttgttgaggtacataatctattggaattttaaaaattggctttaattgaaagattaatttgggaagtgttgatacctttggcatagtaaaagttgtaattcatgaacatggtatttcccttcatttaggtcttactatgtgttgttcaataaaactttgtgacttccatcaagaatatgtacacattttgttagagttatgtttaagtactttaagttgttagctttacaaattgtatcactttttaagaaatgcattttctaattttggttgattctatgtagaaacattactaattttgatgttttgattttacattgagctacagagctgaatgtaagttctaatatgcaaccagcagattcttttgcgtctttattataaaatcattttatctacctgtgacaatatcctttctttctaatcctatacctttgttcttcttgagtccgtttttcataaattacaatctaattaggaaataatctacttcatcatactgtttttttaatttattttcacgtattatccacagttttctctttcataaatctctactacatctgtgaatgttttctccattacattcctaacattgtttcacaccatttatcttttagtctttttagcaacttttccagaggtttttctactttattaatctctcaaatagtactatttttgcttgttggtcttttctattatttggtttgtttattggtttgttttccaactcattaatttctactttctactgcagctatcattattatgtcccttcttttactttcttatggtttactaaattgttttctggtgctctaatacatttgggacctttttattcaccgttgtttttattgaaatacattgcagactacatggttttgatgatactgagttcttattagttattgcctttcacattgtggccaagtatattgttaatttttcaaatgtttcttcttgcttgtaataaaaatatatattcttttattattaggtataggctagagatctactaattgtacactttattctccattacattataaacttctctaagacaaataccacattttatgatttttacatacctggaacattgagagtacccaatacttgaaatatttaccttcttggaacattaaaaacacctaatgagctggaaataaatgaactggaaaatgaagttttgatctcttatgttcagtaaaagatattctttctttgaaaaaataagtatattaacattgaactttctaaagaaattttggttagttttactaaaacctggttagctagccagctatctagaggaaatatataaatatctacattgcatgtaaattattcttcctttctaaattctttttgttccctaattatatgcagcaatttataagtaaatgcatcagctttctatgccaatgaatttttgtccatgattcctctcatcttaattcaacagtaaaataaaactcctatgtgcatcagagatgaatacatttcatgatattatgatttctaaataagtagtccatgcatgtttgtggagacaatacctggtcataatgaagtaaattgttttgttttgtatgataaagcaccataatgaattataagatttaattaggcagtgattctatttcaagtctgattgttgatttgtcattgctttatagagactacgacactataatttaaggactttaatgaaaatgaattaatttgaaagtgcttctaattctgcagcaattaagtgatttttctctcatccactaaaacttatttctatacaagaatggatttgcacagcatcatagtgggaaaaaaatcattattgttagttatcatgaaaggcaatcagaattgaaggcattattatgtgttttaccaacttgccaactattccaccccttccctcaaatacatgcaaaacactgaagacaaatcatatcctctacttgaaggataggaggcggactttttttctctcaaataggctagaaaaagcatatatgggtaatcagttaaatgatagaaatctttaaacatctgagcacattactcttgagactctagtagtgtatacattataaattcataaaggggtctactctgtgacgccttgtgtcagggagaaaatggtaccatgcaattgttctcaataagcaataaatgtgttctctggtgtttggcaaaccattacaccatttatttagagtaaagctcattattttattctattaaatatctcactttcaacactgttaatgagttatttatctgaaatgtgatcactagcacttctttcactttaagactaccttccctttgtacagaatctacttctcctctgggttatggtgttaaagtaaactgaggattgactccttctgtttccattaaagaacatcatggtaacaaaacctaggtttttttattattatcatttcctcctgccaccttttcagcttaatgctggaacttttaactctttctaatattttcattaggacataaaataaacaaataatgccttatgtgtttcactagcacttattccatgggagataaaacttacaatctggttatgtactaaatacaaggaagaacacttcctcacccttttgaaatctgtcttgggctcttttacataaactgatcaattttcctagagttgcagcagagctaagtgatgaacctgtcttccatgtctcagtagatccttaaaaaaaaattaaaagagcaaacttaaatgggcaatgaagcattgtgagtccttcctctacaatgccatgctaccttgcagcttcagtgtaaactccttgaaaacaagaatgaacgttaccttgtttctagatccacaatagcccctatcgatgtccaggcatagtgagtgctcaataaagtggtaaattgataaggaaggaaaaattcatttgtcgagtatgaagcaagattattaaacagttcatttcacataaaagactcaatgtgtttgttgttgaagcagagagagagaaagagagcgagaacaagaggaattgaagtgtcacttaaattaactcatttagactaaaagtcaaattcattcccatgtgaacttactgttggccaaggtcataagcactcctcaaaattttcctcagatgtgtttgtaaggcagaatcagtcgtatgactctctctattgattaccagcatttggtttttcactttacaatgctactaaaataggcagagtcttgcctattttttcttctagtatacaatatgtttgtttcccttctgaaatctccctataatctgcacttcctactcaatagagtattgccccatttttaattttgttttaatcactgtggtcataaattatcctagcaatgtttcttattgcattaccatggttaaatgagtgtaatcaatgaaatttaatatatctgtgttgacttgagttcattatgagtttggtattgaactttctttttagtgtatgtggctgtttgcctatacaccaaaataagaatggtagacatgaagattcctggtgtcagctttgtcattttttccatcatcttctctataaatgataccatcagctataattgcttcaggctgatactcagacaattttaaggaggcatctcttcttacttgctccaatagctattggtcaaattgcatataaaaagtacacctgtattgggtgcatatgtatttaggatagttagctcttcttgttgcattgatccctttaccattatgtaatgtccttctttgtctcttttgatctttgttggtttaaagtatgttttatcagagactaggatggcaacccctgctttttttgctttccatttgcttgttaaatagtcctccatctctttattttgagcttatgtgtgtctttgcacgtgagatgggtctcctgaatacagcaccctgatgggtcttgactctttatccaatttgccagtctgtgtcttttaattggagcatttagcccattttcatttaaaattaatattgttatgtgtgtatttggtcctgtcattatgatgttagctggttattttgctcgttagttgatgcagttttcttcctagccttgatggtctttacattttggcatgattttgcagcgactggtaccggttgttcctttccatgtttagtgcttccttcaggagctcttgtaaggcaggcctggtggtgacaaaaatccctcagcatttgcttgtctgtaaagggttttatttctccttcgcttgtgaagctagtttggctggacatgaaattctgggttgaaaattattctctttaagaatgttgaatattgcccccgactctcttctggcttgtatggtttctgccgagggatccactgttagtctgatgggcttccctttgtgggtaacccgaactttctctctggctgcccttaacatgttttccttcatttcaaccttggtggttcagacaattatgtgtcttggggttgctcttctcgaggagtatctttgtggtgttctctgtatttcctgaatttgaatgttggcctgtcttgctaggctggggaagttctcccggataatatcctgaagcacgctttccaacttggctccattctccctgtaactttcaggtacaccaatcaaatgaaggtttggtcttttcacatagtcccatatttcttggaggctttgttcatttcttttcattcttttttctctaaacttgtcttcatgatttacttcattaagtcgatcttcaatctctgatgtcctttcttctgcttgatcaattcagctattgatacttgtgtatgcttcacagagttctcatgctgtgtttttaagctccatcaggtcatttatgttcttctctaaactagttattctagttagcaatgcatctaaccttttttcaaggttcttagcttccttgcattaggttaataaaacccagattcaaaaagcaagttcttagaaacctacacagagacataagacacctacacaataatagggagagactttaataccctactgtcaatattagacagatgaacaagacaaaaaattaacaagggtattcaggacttgaactctgctctggaccaagcgcacctaacagacatctacagaactctccaccccaaatcaacagaatatacattcttctcagcaccacattgcacttattctaaaattgaccacataattggaagtaaaacacttctcagcaaatgcaaaagaatggaaatcataacaaacagtctctcagactacagtgcaatcaaattagaacttagaattaagaaactcactcaaaactgcacaactacaaggaaactgaacaacctgctcctgaatgactactgggtaaataatgacattaatgcagaaataaataagttctttgaaaccaataagaacaaagacacaatgtaccataatctctgggacacagctaaggcagtgtttaaagggaaatttatagcactaaatgcccacaggagaaagcaggaaagttctaaaatcgacaccctaacatcacaattaagagaactggagaagcaagagcaagcaaattcaaaagctagcaacaaaagcaaacaaattcaaaagaaataactaagataagagcagaactgaaggagatagaaacatgaaaatcccttcaaaaaaaatcaatgaatccaggagctggttttttgaaaagatcaacaaaatagactgctagccagactaataaagaagaaagagagaagaatcaaatagacacaataaaaaatggtaaagggggtatcaccactgaccccacaaaaatacaaactaccatcagagaatactataaacacctctatgcaaataaactagaaaatctagaagaaatggataaattcctgaacacatacaccctcccaagtctaaaccaggaagaagttgaatccctgaatagataaataacaagttctgaaattgaggcaataattaatagcctatcaaccgaaaaaagtcccggactaaaaggattcacagccaaattctaccagaggtaaaaagagtagctggtaccattccttctgaaactattccaaataatagaaaatgggggattcctccctaactcattttatgaagccagcatcatcctgataccaaaacctggcagagacacaacagaaaacagaaaatttcaggccaatatccctggtgaacatcgatgcaaaaatcctcaataaaatactggcaagccgaatccagcagcacattaaaaagcttatccacaccatcaagttggcttcatccctgagatgcaaggctggttcaacacacgcaaatcagcaaatgtaatccatcgcataaacagaaccaatgacaaaaaccacatgattatctcaatagatacggaaaagaccttcaacaaaattcaacagcctttcatgctaaaaactctcaataaactagctattgatggaatgtatctcaatgtaataagagctatttatgagaaacccacagccattatactgaatgggcaaaaactggaagcattccctttttaaaccagcacaagacaagaatgccctctctcaccactcctattcaacatagtattggaagttctggccagggcaatcaggcaagagaaagaaataaacagtattcaaataggaaaaaaggaactcaaattatctctttttgcagatgacatgattgtatatttaaaaaaccccatcgtctcagcccaaaatctccttaagcttacaagcaacttcagcaaagtctcaggatacaaaatcaatgtgcaaaaatcacaagcattcctatacaccaataacagagaaacagagagccaaatcataagtgaactcccattcacaattgctacgaagagaataaaatacctaggaatacaacttacaaggaatgtgaaggacctcttcaaggagaactacaaaccactgctcaaggaaataagagaggacaaaaacaaatggaaaaacattccatgctcatggataggaagaatcaatatcatgaaaatgaccatactgcccaaagtaatttatagattcagttctatccccatcaagttaccattgactttcttcacagaattagaaaaaaatattttaaatttcatatggaaacaaaaaagagcccacatagccaagacaatcctaagcaaaaagaacaaacctggaggcatcacactacttgacttcaaactatactacaaggccacagcaactaaaacagcatgatactggtaccaaaacagatatatagaccaatagaacagaatacaggccttagaaataacactacacatctacaaccctctgatctttgacaaacctgatgaaaacaagcaatggggaaagatttccctatttaataaatggtgttgggaaaactggctagccatatgcagaaaactgaaattggatcctttccttgcaccttacacaaaaattaactcaggtcagattaaagacttaaatataaaacctaaaaccataaaaaccctagaagaaaacctaggcaataccattcaggatataggcatgggcaaagacctcatgactaaaacaccaaaagcagtggcaacaaaagccaaaattgacaactgggatctaattacactgaagagcgtctgcacagcaaaagaaactatcatcagagtgaagaggcaacatacagaatgggaaaacatttttgcaatctgtccatctgacaaagggctaatatccagaatctataaggaacttaaacaagtttacaagaaaaaaacaaccccatcaaaatgtgggtgaaggatatgaacagccacttctcaaaagaggacatttatgcagccaacaaacatatgaaaaaaagctcatcatcactggtcattagagaaacgcaaatcaaaaccacagtgagataccatctcacatcagttagaatggcaatcattaaaaagtcaggaagcaacagatgctggaaaagatgtggagaaatagaaatgctcttacactgttggtgggagtgtaaattagttcaaccattgtagaagacagtgtggtgattcctcaagcatctaaaaccagaaataccatttgacccagcaatctcattactgggtatatacccaaaggattataaatcattctaatataaagacacatggacacgtatgtttattatggcactattcacaatagcaaagacttggaaccaacccaaatgtccatcaatgacagactggataaagaaaatgtggaccatatacaccatggaatactatgcatccataaaaaaggataagttcatgtcctttgccgggacctggatgaagctggaaaccatcattctcagcaaactaacactggaacagaaaatcaaacaccgcatattctcactcataagtgggagttgaacaatgagaacacatggacacagggaggggaacatcacacacaggggcctgttgggggttgggaggctaggggagggatagcattaggagaaatacctaatgtaggtgacaggttgatgggtgcagcaaaccaccatggcacgtgtatacctatgtaacaaacctgcacattctgtgcatgtatcccagaacttaaactataataaaaaatttttaaaaaaagagtacaaagactatgaactaagtttccagtgcttcgcctcagtaaatgattcagaaataaaggactttgttacctgagcataacactcaaaaaagccagaaagtttatactatctgaaatttggcctaagaaaaatatagaacaaatggagcttacaatgatgctttaaggatgctacatagtcaaccctggttgtgctttaaacacggagttccagaaagttaaggttgtttgtatttgacctgaagagtacgtatggaacaaatgttataaatgctgcatcgccagtcttgtgtagctaaaacttatatcccaacgtagtttaaatcctagatttgatggaagcagtttaacacaggttaatatgatagcgtttgaaataagctaggcctagtttcaaaccctgggtaacctctgagcctcagtttcttcattagttaaatgggaataatgaatcactttacaaaattattgtgcagatggaataaagtgcttattacattctctctttctctaagaatagaaagaaccctctgttctttctattctttaagtttaatctaatttaataggtatactaatatctgacttgccttctcaaaattgaaaaataaaattacaaaaaatttttagcaattaaaatatcagatgtagatattgaaatcttataaacatgtttcctgtctttatttcatatgagaggtatcattaggacttttgtctttattagcatataacatttatatcacagagtaaaccatttgggctgatgatatgtgtaaaattcagaaaacataagcattcaatatgcattattcctattatatgtgtattgatttatacaaaaatttataagaaacaatttttatgcacttgagagaacactaaatcattcaaaatttggtatttgttaagaagtatgttatgtctgtatggtagatgttttagatcatcacctcaagctattgatgcgaaactgtaactagatgcaatttaacaagcaatggctgagtttccattgttttcctagcattaacttaggtactgtcaggaatatcaagaaattgagtgtcaattgatgaatccataaccccaaatatctgaccccattctcccatttccagaaccctccctatcttcaaacatcttttaccccatcagaaccaccaatccattatattggcatcttctcatgcacttctccacaacatcgatgttttctctgccctctttatatggttcaaattctatagtcaattatcagattactcccttgtggacccccttgacaccctttcttctctctcatgtcactgtgcttgcttgctcagcaaaattacaaccctggctgaattcaactctctaagtagtgctgaaaggaactagcaaaaagactcaaccataccaactgattgaattcatggttgcaaatctgaagtgcagtcttgaggcttaccagtgatcatttcatacttccctagtccattgactctccctctgttctggggacaatttcatatcttctctggctttaaaccatccatacctcctttcccatcttcatgactactaatcctactcttctgaaaaaactaaagctcacttcagagaagaagcatgtctcatttgctatttgtgaatacggcaattttccattttttaaattaaatataccattttgcctataaaacataatgcttcccatataattactttagaatacagtccttactgtaaatggttgttcagcctaggtttgaatataacctaaatataataagcttgggtctccagggaaatcaaaagaagtgaacttgtgggttcccttagaagagagttcattgtgggcctgtgatagaaatttttagtgatatctcagctgaaaaatagagatcagagcttggattacgtggtctacaaattattgaccctgtttaatcacaagtcagaatgtttggaataagatatattgctcaagtaaggccatttattccatgtctgaatgaataaatgtaaaaatcaaaacaaagttatatcttagaaagcatgcatatgtatatatacaacaaatatatataacatttataagtaaatatatgtacatacgaatttctttataaattgaaaacagttgtttctgaggaccagacagaagattacaaaggttgattaataaaagtatgggctttatttgtctaatgacatatctaacaatttcaacaggtggttgcataatgggttaaaaaagatatcgtgttttgaaaattttattaaatcccatatatatctattctcatctgtaaacacccattagatatttaaataaaacttctactcttgtaaatgtgtggttcttcatttgaaaaatgaaaatcatattgcttaatacagcttcaaaattattgaaagaattaaatgattttttcacagtgacaaagtgaagtgtaagttaccttatacttattaattaaaattcttattcatactataattttatctagaatttttcaagtacttattaagagccagacatgatactcagtgttttacattcatatcatcaaatactcagaataaccctctgaattcaacaagaaatgactaattctttcaaatattataatgccatctaagattaaatgctcagttaagtgacaaaactggtacttggtcacctttccaacctgtgcttttaaccactacacttttaactactactatttctctgtgtttgggttgaactcctaggtgaagatatgctcaaagaactttccctaaactctagaactcatatattaatatacatggtgaagagccactggtaacctacttttctaaatgtgttccaagaaattaagcaaattaagataaccacaaaagcctcagcaaaaatgttgctgagcataaactccatcgactcaatagctgaaacaaaagcatactcttactttcttgccacattttgtttttcctgaatttaatgtttgttttgttgattttattgcttagctttttgtgaggttttttttatcagtccaacccagaactctccctaagctgcgtaaatttcctgtcaatatgttcaaacacattagttgttctttcacttatagctcattgggcaaaaattctctaggagctttttgaactgatgcaatctagactgtgtgctctccaggcctgctgtgagcctttgccttgtgaaacctccaccatcattctggggattccctttgcctctcttatgttggaccatctggttcctggttacatttcttccttaatacatcattttggtgacaaacatcctacagaagatctttggaaaacggtgtgtgcaaaataaaaatttggggaacttgaacatctgaaaatatcttttaaaaaaatctaggaggttattacttccaatcagacagcttattttcagctcagttaagtttaaaattttgttagcttttctctttagtatcctcagaaggttggctgtgtcttttttttggaatacccttccacctgtttggtaagaacaaggcaactttaaaaaattctgtgttcttaggaaatgtcatttatttggcagggatcccaatgtgcagcacagcttgatcccccttcacagtccccaaaacagctaggcttgacaccaaaaagctctttcaatgacagccattcacttatcaaaattattctgaacttagagaatatggctttaaacaaaaaatgtacttcaagaagctctttctcagtctgttcagggggctataacaaaatactacaaactgggtgacttataaacaacaaacatttatttctcacagttctggaggctgggaaatccaagatcaaggcactgggaaatctatctcatgagggcctgttcctcatagacagtacctcaattggcatatggcccatagtgttcttattaaaaagaccactgggagcagacttgccccttctcactatgtcttcagctggtggaaggagcaagacagctctctagaacctttatttatttatttatttatttatttatttatttatttatttactatttgagacctagtcttgctgtgtcgcccaggctggggtgcagtggcatgatctcagctcactgcaatccccacctcctgggttcaagcaattctgcctcagcctcctgagtagctgggattagaggtgcccgccctcacacccagctcatttttgtacttttagtacagacggggtttcaccatgttggccaggctagtctcgaactcctgacctcaagcaatccgcccgcctcagcctcctaaagtgctgggattacaggcgcaagccactgtgcccagcctcgggggccattttaataagggcacttatcctattcatgaaggctctgctatcatgacctaattatctccaaaatgcctcacctcttaaaaacgtatcaccttgggtgttaggatttcaacacatgaacttgggaggatacaaatattcaaaccgtagcaggaacattctgacaaatctgcagccagtatttcttctccaaaagttgttttagcaattgcatggttttatgggcatttcttatctctatattttagtggaaggcctgaagtgtcccagtgaaaaaggtgttgaaacatttttgacagtgtccttgtttcacagttggcatttgactatgtttaactgaaaggtagaatgtaaatatttaacttccattttctatttaatttaaaaaataactattttttcaagtatacaacacagtataattactaactatagtctccatagtatatattagatctccagaacttgttcatcttataactgaaagctcataccctttggccaacacctcctcattacccgcactccccagcacctggtaacaactattctactctgtttctaagaattagacttttttagattccccgtataagtgatgtgatgccatatttgtctttctatgtctagcttatttcacttagcatgtcttccaggcccatccatgatgttccaaataggaggatttgcttatgctttaaggccaaataatatttcattgtgcacatatatactatgtgcatatattatatgtgtagataagatatacatatattatatgtatgtaggttttgctgtgcaaaaacctttttattttgtatagtcctacttgcttacatttgcttttgttgtttgtgcttttggtgtcacattcaaaaaaaccatttccaagtccaatgtcaaggagctctacccctactttttattccagaagttttcaagtttcaggtcttatatatatatataagtttttaaagtttcaggtcttatatataagtctttaatccattttgggttgatttttgtgtattatctaagataagggtccaatttcattcttctacctgtgggtttctagttttctcagcaccatttgttgaagagactatccccattgtgtttttggtacatttgttaaccatcagttgattgatatatatgtggctttttttctgggatctctaatttattccaatgatctctaagtctgtgtttgtgccaatatcagcccgttttgattataatagcttagtaatgtaatttgaaatgaagaaaggtgaggcttccagctttttcttcttgctcaaaattactttagctactcagaatcttttgtgatttcatataaattttaggattattttttctatttctgtaaaaaaagtcattgggattttgataggaattgcatttaatctgtgaattactttgggtagtgtggaattttaaacaacattaattgtttcactccgtgaatacatgatatcttctcatttatttttgtcttcaatcttttcatcaatattttgaagttttcagtgatacagatttttcacctcagttaaatttatttctaagtgtggtattctttcccacattattgtaagcattgttttatttctttttcacatagtttgttgtgagtgtatggaaacaaaattgacttttaaatgttgattttgtaacttgtgctctactaaatttgcttaatagttctaatagtttttggtggattgtttagggttttctatatataagatgctggcatccacaaagagggaccattcagctttcctttctgacttagttgccttttatttctttttcttgcctaaccctctggttaaaactttcagtactatgttaaatagaagtgacaagagtgatcatccttgtcatgttcctgttcttagatgaaaagctttcaacttttcactgttgagtatgatgttggctgtagtgttgtcatatgtggcttttattgtgttgaagtacatttcttctatacctaatttgtggagagtttcattatgaaaggatgttggattttgttcaatgcttttttctgcatctagtaaaatgatcatatgattcttatccttcattctcttgatgtggtgtatcacatttattgatttgtggatgataaaccatctttgcctccccagggtaaatcccatttgactatggtatatgatccttttagtgtgctgttgtattggggtttctagtacttccttgaggatttttgcacatatgttcatcagggatgttggcctgtaattttctttttttgttgtttcttgtctgggtttggtgtcaaggtaatgctagtcttcgaaattggatttgaaagtgttcccttctcttcaattgtttgagaaggttgatattaattctcctttcaacatttggtagaattcacagtgaagtcatagggtactgggcttttcattgttgggagatttctgtttactgattcaatctccttattagttatgtctgttcaaattttttattcatgattcagtctaagcaggctctatatcaataagaatttatttcttctagattattcagttgtttgttggaatataatttcttgtagtggtatcttatcatgatttgtatatctgtagtaacagttgtagtgtcttctcattcatttctgattctacttatttaagtaggttcccttttattcttactgtagctaaaggcttgtcaattttatcttctcaaaaaaaacaaattctagtttcattgatcttttctgatttttcttttgtcactgcttcatttactgctgctctgatatttgttgggtttgttcttatttttctaattacttgaagtgtaaagttagcttgtttatttgagatctttctttgttcttaatttggcatttatttctataaacttccctcttaaaactgcttttgctgaatcccataagttttggtatgttgtatttctatttttttttgtatcaagattttcttttaattttccttttgatttcttctttgacctaatggttgctcaggatggtactatttggtttccacatatttgtgaattttccagttttcctcttgttagtgatttctggttttatatatatcattgctgttgaaaagatacttgatattatttcagtctttgtaaattttttaagacttattttgtggccttgcatataatcttcctgcagaatatttcatgtgtgcttgagattaatgtgtattctgctgctgttgaatggaatgctctctctctctctctctctctctgtgtgtgtgtgtgtgtgtgtgtgtgtgtgtgtgtgtgtatctgcataatctaccctgttgcaagcagggtatcgaagtccctactattattatattttatttcatttctcctttcagtctgtcaatgcttgcttcatatatttaggttatctgatattgggtgcatatatatttaaattatatcctcttgctgaattgacacttttatcattatataattaccctctttgtcacttgtgacaggttttgacttaaagcctattttgtctgaaataagtacagatactcctgctctcttttggtttatatttgcatgaaatattatttctatccttcagcctacataagtccctaaagtttgtttcaagcacgtgtagttgggtcatgtttttttcacccattcaatgactctatgtcttttcattagattatttagcctatttacatttaaaataattattgataggtaaggacttactattaccattttgttgattttttttctgattgttttatagtttctttgttctttctttttgctctcttcctttgtgatttaattttatatggtggtatgttttaaattatttatttttatcttctgtgtatctactataggtctttgctttgtggttaccatggggctacattataacataggctatgttataacatcttatagttataacactattttaagctgataataacttaactttgatcacttataaaaaatccacacatccccatgcacatacacacattttaggtatttgatattatagtttattactattatcattataatactttaagttctggggtatatgtacagaacatgcaggtttgttatgtaggtatacacgtgccatggtggtttgctgcacccatcaacctgtcatctacattaggtatttctcctaatgctatctcttccctagccccccaacagaccccagtgtgtgatgttcccctccctgtgtccatgtgttctcattgttcaactcccacttatgagtgagaacatgtggtgtttggttttctgttccagtgttagtttgctgagaatgatggtttccagcttcatccatgtccctgcaaaggacatgaactcatccttttttatagatgcatagtattccatggtgtatatgtggcacattttctttatccagtctatcattgatggacatttgagttggttccaagactttgctattgcgaacagtgctgcaatagacatagatgtgcatgtgtctttatagtagaatgatttataatcctttgggtatatacccagtaatgggattgctgggtcaaatagtatttctagttctagatccttaagcaatctccacactgtcttccacaatgggtgaactaatttacactcccaccaacagtgtaaaagcattcctatttctccacatcctctccagcatctgttgtttcctgactttttagtgatcaccattctaactggtgtgagacagtatctcactgtgattttgatttgcatttctctagtgaccagtgatgatgagcattttttcataagtttgttggctacataaatgtatttctttaaataagtgttatgtactttctcttcttattctgggttttctataatccttattttatttctcttgagggtgtcccataaatcccataagctttcttcattccttttcattctgtcttcatttttctactctgactggataatcttaaatgggctgtttccgatttagcatttgtttttcctgcttgatcaagtctgctgtgggagttctatattgcattttccatttcatttattgtattcatcggctccagaatttctgggatttttttaatgatttctatctcttcatttaacttcttgttttgttcattgttttcctgattttattgatttgtccatctgtgccctcttgtagcttacttagcttccttaaaatattaattttgatgtttttgtcaggcaattaatggagcttcatttctttcagtttggttactagaaaattgtgttcacatggtggctctcgcctgtaatcccagcactttcggaggttgaggcgggtggattacctgaggtcaggagttcaagatcagcctggccaacctgatgaaaccccatctctactaaaaatacaaaaaattagcctggtgtgttggtgggcatctgtaatcccagctactcgggaggctgaggcaggataatcacttgaacctgggaggtggtggttgcagtgagctgagattgtgccaatgcactccagcctgggcaacagagcgagactctgtcaaaaaaaaaaattgtgttattttggtggtgtcatattcccttgttttgttttgtttgtattcctggaagtcttgtattgttgtctttgcatttgaagaagctgtcacctccttcagtctttactgacttgcttcaggagagaaacaccttcaccagtcagccagatgatggattctgagtctttctcagacttttgctgtggatgtgcctgctccacctattttgtttcctcttgggcagaatttcttaagattgcttgccctttctcagtcccacaaagccaggctgtgtgctgggagtctctcacttgtttttttaggcaatgctctgaaatgctaaagtttgtgttccttctcccaatcccacaaactcaaggtggctggctgtgtatgctggccagacaacggcaagtgctcacactctctgtcaggcacatgaaaggagctagctacagttatagaagggaggctgaaaaacacaacgtgttgggaggacctatgaatcagttatggtggtccacaggtgaggcataccgaacaggtcatgggcaaactttgtgttggagaatagtagaatatacagctctttgttaagttttgaacattggttgctgacagtccgtacctctcctcccagctcctagcctttcccagccactcagccttgttgatgccctcagtattctaagtggggcaagaaagaggtaggcctctaagacaatgtcccacacagttgggcaagcctcactcactatatttttactttcccctgtggggacaattgtgagttgaaggagtttctcctggcattgagctgtgctagcttgagggtggggtgaaatgggtaaaatgaaactattctccgtactatcttcaatgagtctactctcataagctttgctccaatgatatgctggaatttgtccgctggactcccaaactcccacaaaaatactctcatctgcaggtggttgccaaaatcagtaaactgtgagatgttagaaaactcctattctgccatcttgcttatgtcactgaaaatatctttattccacactcattttcatagttttggaatattagtttggtggtgtataggattttagttgaaaatcattttccttcagaagttggatatagttctgtataattttcttattccaaatatttttgagaagtcaaatgtcatctagattttgatcctttgtgtgaaacctgatttttctctcccctcttaatcctcgatattccttgaatgagtgagcttttctaatctgaaataatcttattcattgtttgaaattactgaaatattcttgaattgttcctttcgtattttctatcttttgtgttctcagtttactcttctttgaacttccattactcagatactaaaatgtctcaactattataaattcatctttactgtctttttgcctaatgttaccacattttctagaagacttcttcacatttatcttttgattcttctatagtttttctttcaatcattcttctgagttagaacatcaatttaagaaaaatgtcatgaagtctttttcatcccattttttatgtctgtaaccttggcacaatgtctggcacttttgggtcttcaaagaacagcagctttaaaagtgtgtgtgtgggaaaaaaagtgtgtgtgtgtgcgtacacgcacattaataatgtatatattcacagtatatatattatattatattctttcagcacactaattctttttcctgtgttctctaaggtagataaattttatacgtttatacctgaagccagataattttgatatgtttttggttcttttcttgacttacatcctctgattcttttttatttctaataattatagatagcattattacagcactttgtgccaattgcttttctgtataatctcttttaatcctcactacaactctatgataaaaccattcatataatcactatttttcagagtagaaaactaaggcattgggagtttaaaagacttgcctagggctaccagccagaaggtatatagctaggattccatctcgagccaacagactgtgctctgaattattttaaatttaaactgtaaacaatataatacaaatttttaaacaaataatatagcaccattttcaccacagtaggcaattccattttcagtagaagataaagagacgtcatctttttcttaaaatcatattttaattcacttctgcctccatgtcctgatttacacgtaattcaagcatataccattttaagacagggacctgtggtgataaggcatcatgtatagcagcatgcaatgagcccagattggagagtgaacagaaaaagctaaacggagaaaaggagaaatttatactactgtccattgaagatatttaaagaattttatgggaaaatgttaagaataattcacaacttagattattgacatggctgcctttttttagtgactatttaatggaagaagttctaggtgtttcggccttccaaaaacaagagaaacaggctttttcattaaattcatacacaatggagctcccaaacttttggaggctcttatttagaagtcagaatagttcagtaataattttaggaccgcatgatttctggtgaaattttaaatagagagaaatggcgtgagaaacatcgcaaaccccactttgtacccctttgtacccctatttggcagtggataagtgacctgtcctggatttgactaccctgctgcttcaagggctttgaagtcctgtggacatggtattctagatgaatgaaatctaaaaaggtggaatattttgtttcttgagtatccatcatcaaaaagttcaattatatcctgccacaaagtgttccttatccttctgtcagatatgaagtactgggaaaggccagttctttttgaaaatttttgcatccttgataatagtttcaaaaattgagagaaagtggtactgcaggcatatcgcataataacagcttcatatagcttcttcccttctaacttttgcagggcctactacattgatccatttctgtcaattgattgaaatgtcccccacatcttttattcctctgaccctcacatttatggattaggtttcagcttttgcattttcagtttcatagaaaaatctgtgtttttctgtcacacagccagtagcacagctgtgacagcagatgagcaattctccaagggcaatcagccaggctggctacctcagagactccagggaggacccaaggaaaactgcttgtctcttcacactttcaggcagatgcagagctacactctgtacagccaacaaaaaagaattgtataaaatttagcagagccccatattagtttgggaatatctatcagttttgggtgtattcctaagtatttttcacatgtataagttcaaccttcctaaccttataaaatgattattggaagtaaagattttatcttctgttttctttacatctacttgttctcccttctctcagtagcagcactataacttaataacttaagctatttttatttctttaggttaccaaagatcaaagatttatcttaggccaaatacacaattgtcctcaattttacatccaattttaaacttttattataaaatattatttaacattcaacctttattaaaaattatgtatatatgattaataatattgatatgttattaagtttttatttctacttaaatgcttatcctaaatggtgtttacatcatgtactgactcatagttttaataattatctaaatattagaactatagtttaaagaatatttgttggaacattttcatgtactttgtttttttcacattttaggtgtacaagaatttccagaaaacataaagtgctgtaagtgtttaacaattattgaagccagtgtcaatcccatttctaagtgagtatgagtgattaaattttatttgtatttatatttccattgtataataatgtacctaaatagaggaaatgcacatcataatttaaatttaaatgtagcattgacatagcatttaatagaatgatgggaaaaattaatcagaatagtttgacaaaagatgattaaaaacattgctgagtagcaaggaagacccaattggcaaaagatggtatgactttgaaacaaactttgtcaccattttccacagctctcaggtaacactccatagataagagttgaaactaataaaacagttattagtaatggtcatggtggaaaactagcatcaaggactgccagaagttcaagatactgcaagagtttaaggtattgacaagtgcataaaaataacctatcatgtagatcaagggaattaagtatgaccagaaatagaaagtacttgtataccagagattgcagcaagaacaaagagataaccctaggagaataggagaatggaagatatggataatagagatgctgtgatcagaaaatgggtatttgtagtccaagatctgttcattaagaaatgccatagaaaaatgatacccagcaagtgaccatgttggtaaattgagcatatggagtagtgacagaagtctgtggaatcaagtaggtcaggaagcaataaaataaattgattggaggagtcatgaacctgaatgttaaagtcacttaataatggaagtagaaataaaatctagagaggctcctgacagttgtaatatttagaagaggttgaaataagtcagttgtattgggctgcaaaaaatgagcttcagagtaagactggcattttaattatacaaagctgacagtaggatttgagaaaaattcctcgatcttttgtctgatgaagtgtaggaggctaggggaaaccgaagcccattggaaagacatttaatggatggagtatttttagaagaagacataaataaatttgtcaaagggaagttgatgggaaattttataccagtagagttgaggagagggagtagtgaaagtggttctctatggatgatgggaagaggctctagacaaggtgaggagtgaaatagatgtaaaagaatgagatcgaagtttagatggagatctttatagtgaatggtttgtgaaataatctgaggccttttgtaggaaatgtaaaacatcaagcaacaaaatgtgtttaaaaattacagtttttcttcctgaaaagtaaatagggagggaaaaaaaagagaaaataaaactctaaaaagcttttcccaaaactcgtagaccaaaatgcaattttttcaacatctcagtgaaatagatgttactaatttctcccaccaggactacagtcatgtccttgacttgagtcaaaacaatccagtgctgttgataaattgcttttttcctcctaattatttaattctagtagctcgtcttatttaggaatcatggtaggtctttgggagtggcagccagattagaaattacatctttgagaaatttcaagtctatggttttattggatatgtctaattcccttcatatgtataactttttaaaagataaataaatatgacctatttcagcaaaaatgcataacactgtaaacattaaacagttttgaaattcataaaaattatgaaaagtcaacataaattgtttatcaaattttaaagtcatgtttttaaatatgttatttctatacaataaaatttactctggccaggcatggttgctcacacctgtgatcccaacacttaggccaaagcaggaggatcgcatgagtttaagattggccctggcaacatggtgaaaccctgtctctataaagtatgcaaaaaattggcctggtgtggtggtgtgtgcctgtagtcctagctgcttgagagactaaggtgggagaatcactttagcctgggaggacaacgctgcagtgaaccatgatcatgcccctgcactccatcctgggcaacagagtgagaccctgtctcaaaaaaataagattaattctatttaggtgtatggttcaatgaattttaacaaatgtatacagtcatgtgaccatctccatagtcaagatatagactattgcatcatctcaaagaattcccttagcccagtcatccactgacgattactatccccattgctttgtctttttcaaaatgacaaataaatgatatcatacttttgtgtctgacttcttttacttaacataatgattttgaaatttatttgtaatttttcaataatcagtacttcattcccctttattcccaggtagtattccattgtatggctataacattatttgtttatctgtacctcagttgataggcatttgggttgtttccagtttttggctattatgagtaaagctggtacaaactatgcacaagtgtttgtgtgagcatatattttcatttctattgagtgaacccctaggagtagttttctgagtcgtatggtatgtatatgtttaacctgataagaaacttccaaatcactttcccaaagctattcaaatgtgtgttacaccagttcaggtgttcagagttcagttgttcttcatctttgccagaatttggttccatcagttttttatttttttccattttagccagtgtagtagaaatggtatttcaattatggctttaatttatatttctaatgtctaattagcacctttccatgtatttatttataatctgtattgctttatacattaaagggagaaataatgatataagtttgcagtgttgttaaaacaattaatagattagaaagaaataaatgaaatgataatcatggttgtgctaaggaggtaaaattatgagttacacttttatctttattttccaaatgttctctaacattatgatgttcgttttataattttaagctgcataaatgaagatgttttgatgtaaaatgcctttccagctagaatagaaacttctacgttgtgttcttattcacaacatataaaacttagaattttatatggtttaactgttctattagaggtcagatgcttgtaatatgttttcatcaaacttctagagtaaatgcaattagaaaagaaaaaaatgttgaaataagggtgactgaaactgatcttaatttgcctattccaatagtaaaaattagcaattatgaaagtatttaaaatagtattctatttaatgtttattgaaacatcaaaataaaattcttactaaataaaagtattaaaatttctttgatttgctgattcttactatgggataggtagtcattcaatcattagagcaaatctgagcagcagatattagtattatcatcttacaaataaggaaatcaactatttcaaatttaagtaattgcaaaggtcacatgaaaataatttgaagacctgtgattataagcaaagtcttctgatatcaatacatgtgctcaactgctaaactatatgagtgtctgggtctattgttattctatctttgttgtagttttttaactgatatatatagatgtacattttgggtgggcacatgtgataatttgatacattcatgtaatcaaatcaggataattgggatatccatcactttaaatatttatcttttctttacactagggacattctaattctcttctgactattttgaaatgtaaaattaattaatgttaactagagtaaccctactgatctatcaaacaccatatctcatttgttctatgtaactgtgtatttgtacataccacttttaatataagcaattaaagtatttacttagcagaatgaattatttgctaatttataaaacatatatattctttgaatttttaaataaatcaattacatgtgaaaagccaccaagttattttaggatagtaaaatcatttcattattgagagttccttacttaatgtcaaagattagatttcattgaatactttgcaggaaagtaaaggcaacttatgattgtcatcttcatcaagtgtatccagcttgctatggaatattttcttcctcacagttcctcatacatttttctggaagtaattatattgacaagtcaggcccttttctctattagaaactacaaaatgtaccataaaattaatgataaataactcctcaatgggaaaagcaagaactaacatttattgagaacctatgtcttaaacttttagatacattatttaatttaaattttacagaaacctcattatgtagataaatattattacctttttatagagagaaatgcatgaagccagtatttaaattcctaagtttctttcactgtatttcaccatatctgataaggtatttttatttgctgtaggatacattctcaaaaatttaaaacattcttaatgctcagcagtgaagaaattactagtaaattacagtacatctatggggtggatatgaaagttataagtagagtgaccaagtgtctctgtttgcccaaatcatctctgtttactattcttgatttggcatatttactaatagctgcctttttaactctcacaaatgtcctagtttgaattataaattctttgaatatctttgaatatcttttctggcagactcactgactgtatatatatgatttttcaaataacatcgaatccatttttcattctatgttattttcaaagtacaataatggacagtttaagagattttaaaaattccttatccccaaataatttataatttttcccaggaatagaaaatttccaatactagtacaaagtattattgtataaacattcaactaaatctatgaacagaatcctatgaggaaaataaagaagacattaattttgaatctaagtgcagagtaaccattcaataaaaaattcacgttgaagtgagttgaaataaaacatagatgtcgttaaataagacatactatgtaatcgtattcttaactccacatttttaagaagaaaagttcaatagaaaatgtcaatacatctttttttataaccagcctgataaaaactgacttactttgcatgctggtttttcatataacctatttttgctggtccagttttgtcactggaacctgaaaaaatgtggtcaattcttaaactctgaaacaaaatgttctatgtaataagccagattcttctagggcataagcattaccaaagaagaagcaaaaaagaagtatatttttgatcaaagaagtagtacaatatcatttattacatacatatggagaatagtagactgagagaagctgcatagttttgatatataggaaaaatatctgtccctaccaatagaaaattagtattttaatttaacagtgacactgttaaaataaattattagattaatggttttaacattcgtctaattttacatgtatcatattgatcatcttttttgaaaagtcatatgtaagtagttgttttgaattacaagacatcaaagataatagttaaattccaattgaaatgtatttaacatctgtgccattctcataacaactgtcatactatcaggacatgagctctaatgcattacaacaaagtaaaacacagagaaaattaatgacctaccatagactttcatttctataagatcaagttcaaacctttgagttgagtattcaaggactgtaaaccctgccctctcctgatattcttaaatattaactctggatactctcatacataaagtatttgctgcagaactcatcttctctttgttacacatctcaagtgttttcttacctctacattataaaaaccctcatttttcacttgcctcccttctctttcttttctacttccataaatcctatgtctcttaaaagcaaatttatggcaacatcctctatgaaatcatatccacagaattcaactccaaaatacaaactagaacaatatatttacagtgaaaataaccaatatcagaataatatacagtaagtcttcacttaatgccattgataggttgttggaaactgtaactttaagtgaaaggacatacagcaggtcttcaaataatgttgtttccttcaacattatttcattataatgttgtagagaagataaaaaattgttctgttatacatagtttcacttaaatttgcagtttcaaagaacctatcaatgacattgaggacttattactaagaatgtataaagaattgccataaatcagtatgaaaatataaatgtgtttgttttagattccccagaagcagacgtttagaaaagaatacagcagtgtatttgggagataagcccaggaaatacttgttgagagtgttttttcaagctgtttacagtatttggccattggactttaactttctggggaactctgggtaacagtgtaaaacacataccagggttatcaaacacaatgggagagggagcagaggtatttatattcctacttgtcattagttgagtactgtctctgagagggacattaattccatggaacttgggctaccaggtgcatgaacagaccaggctttagcagctgaagaaaaccttcagacaggaaggaaaggggcaggcaatcatgatttgttccagtgtacaacaaaattataaaggcagggagttctctggttggggcaccagtagaaaaataggtaaaataagtaaacatgtatttcacagaaaaggaaacaaatcttgctaataaacttttattcctaactaatcagcgaaatgatgattattactattttatatttaccaaattggcaaaaatgaaaaaactaacaaaaccgagggttaggaaggacatggaaaaatggtggaactattttgaatgaaatttggctacatctagtaaacatagacttgcattccctatgaccaatgatgtcacttctaaggatataacttaagtaatattttgtaaatgtatactgtatgttcaaaattattcacagaagccaatatttataatagcaaaatgaaaaactagaaacaactgtaggtcaggcacggtggctcatgcctgtaatcccagcactttgggaggccgaggtgggtggatcacctgaggtcaggagtttgagaccagcctggccaacatggcgaaaccctgtctcaactaaaaatacaaaaattagcagggcgtggtggcaggtgcctgtgatcccatctactcaggaggctggagcaggagaatcactgtaacctgggaggcggaggttgcagtgagccgagattgcaccattgcactctagcctgggagacaagagtgaaactctatttcaaaaaaaaaagaagaaacgactgtaatgttcattagaaggaaaatgttaaattgtttattcatacagtggaatactatgctatgatggccaatcagtcacgtcaaaatggatggattttttaaatctaatactaatttttttaagccttggggaaatgtacacagtgtgatttgatttatataatgttcaaaaccatgcaaaaccatacaacatgttttgttttagggaattaaatatttgtagtaaagctgtttcaaaacagagtagtaaacatgattcaggaatttgtggggcaaataggaagatgtagacagggagggacacccagaaggtttcaaagatactgattctatttcttcattctgttgtgggtacacatatattcttttatacgtatatgtacgtacacacacatacatacatacaaatgcaaatattatatgtatatatataagtgttttatatatacatacaagaaagtattggacataggaagataaaccatggaataaaacgcagatataatgtcccaggagaaggaagagaagcaggaaaattgtagtagaagcaaagaaggagagaacaagcagtgatggcaactgttgctaggcagcgtaggatccgaaataaaatgaggctaatgggattggaacttaggaggtcagtggaggccttggtgagtgcattttcagtaacagaattgaggtagatgccagaaaacaatgacttgagtagtaatcaaaagcaatgagtataggcagatttttaaacaagtaaatgcaaggaggaagataggctgtaatttgaggagaaggcaaatttgaagactatttaggagtattttataaaataacataatctggactagactatacataaaggcattaaaatgtttaaatagaaatttactaataaaaaaattaatattcctctgaatatgtctcctgagaaatccttgagttaaatctttttacatttaaaataattatttcatctaatttctaaaactccccaaaggttattttcttaattttttgatgcagtttatagcctttatgattgtctaattatcttttcaatgttctttgtcatttttaataaatatgaattagaccaatttgaatcatgatttacatacatgttgagcagacattaaagaaattattagttaaggggacaacatactccttcacttttcatactgggcaactttagtcatcgctgtaacaaattgtagacaaattttgatgattaagtgaaatagtaactggatgctcttgcctgactatatatgtgaatattctgttgaaaaaggaacattagttttaaaattacaaacaagccaaacaacttgagatttccatgaaaaatgtcctggctagcgtgcataaggttaggccagcaataagagatgatgttgctgattttagcagtgacataaatcttagtataggagagtagcatggaagtggataaatgctatttactttaataacaggcaaaattttcgaactgtaacaacatgctcaataaattctttcattactgtaataccaaaggagagttgaaaaatgtattacatttctattttttctcctcagagatacatattttttttgttctgtttctatagcaacatcaatgcagtgactaaaactttaactcctttttagactacctgatggcttcacacagctcctaaacctgacccagctctacctgaatgacgcctttcttgaatttcttccagccaattttggaaggtaagaataagaaatttaaattatgcaattatatctcaccttaggtaagtgctttaccagtgccagttgatgagacttcaaaagtgtcagttgtgattaaagataggcctcattattattcaataaatgaaacgctgttaattaatgaaacttttgcaaaaatataaagtaaaattaggcctttacatgacattaatagtcaaataaattctagatgaattaaagagttggatataaaaaaaaataaagccagaaattatctgagggaaaaaaaggagatgaatatttatggctcttttgttgagaaatacctttataggcatagaagcaaagaaaaatatcataaatggatacaatacatatgatgacctaaatacttttaacataaagtatcagaaaatcaaagatttaaggtaaaacaatcaactgaaaaaatagtttcattatatatgaaaaacaaattatttatatatttaacatagaattcttacatataaatatgaaaacaaagattttagagaaaaatggtcaaattacaaggaaaaagcaattcataataacacataaatggctggggaacacataaaaaaagtctgtcttcacaaataataaacataatacaagttaaaacaataaaagactgttatgttccaacatattgcaaaaaaattttttagagtataagaacagagatgatctcatgctctctgataggactgcagaatgttatgaccttcatgcagggcagtatgcttttaaaacctttgaaaatatttaacaaccattgcctttgtgaatcatttctagaaatgtctattgccattgtcagatatcccactaggatttatggacaagtttattgttatttacaatgtgaaaaaagtggaatcacacatctgtctaggatattggttaaatatattatggttcatctatatgatagcactatataataataatattatcttagggaagtattttttaaaattcttaagatgtttccaatatgaatatgactctgtaagaaataaaagactgtatcttagaagtaaaattatgaataatttttcttgtcatcttgacatgtttttcaatatttttcaggtgttctacaatgaacttttttgtgcaaaagatatatctcaataactaggacatttttaagtttactgtcaactgaatttatgtaaatgatagtctttgaaattgttcaaataatagactaagtatagcttgacaccaatctgttgactgaagctcgcacaggacattaagaactcagttgaataatgaagtcacttaacatgtgacagcctccatttacatactgagagcacatcaacctttcccagattcccttacttttgcagatcacgacatcactacacttatgaacagcatatacttgagcagttttaaaattcacagagcatccaaagagcactgtttggcttctgaatgaattggcatttcatcattcatccacagaaactagccttgcctttctggtactgaccacagccttacaacatactttggatttatcaaatcagaaaatgtttaattattatcttaagatacatttttttcttgaatttttaagttctctttaagtagtcctaatgtgagaaaaagatttgggcaagtgaaaaacataataccaataccaaaaccacttgaaaatagaatttaattttgcataaattgcctacaaaaaatatgctctattttattattataatctgaaaatgtctttaaccatcaactggatagtttaacaagaggacacttgaaattccttttaaaacctgagattctgtactcctaaaagccaaaatcagtacaaaatattatactagtacaattgttgagaagatttgagacatgcaaatgtttaagaaatctcctttactagcaatatacccatgccgtgaagaactgaatcactttatttcatatacagattaatcattataagattaaaattaaataaaaagcttgataggaggcaaaaaaaaaagaaaggaaagagatctacatgaaaacctaaaaatacagtaaatatgggagatgtagatgaaaaacttcaaatggtaaaatatttccccaaacattaatgattcagagaatccaattaatatctgttctaaagtagcttcatctgagtacattttaatgttctatatggacaggaataacaatagtgtgtcctagactgcaaaacttaacaagtaactaagtgtgaaatgcattcctaatcacaaatgttactcaagcaaaagaaactctgaatacctctcattcttttcacatgatttccccaaccccagcattgtcatgggacagatgatgtgacagatttttacatgcataacattttcataaatgttaaaatatgcgccttagagtcaatgaaatatggtatattgcagcacttctcccattgtgtaaataatgaaaataataatagccaattcttattaaaacttgtgatataccagaaattatgctttacatgtattacattatctaatgttccaaaccatataaatctgatactgctgtcacagatttatgggtaaggaaattgaattaagagaggttaagtaatttgcccagtgtcagagaggcagaatatgaaagagtttggatttcatccaggtttgtcttcctacaaagtcccatttttttaactctatgctatagtatttgctttttagtttatttataatctcttgagagaaattattgccatattccagtgaacacagcatctggtatttagtatacattcaattatctattgaatggataaaattaaacaacaaatatacctttataaaacatatgaaatttagaaggctggaatccaaagatatctttaaaatatctcagttaattttaggaaaatgatatttgtcattgcccagtattgatgtaaccctactcataatcaatatatatatttctttaaaatctataacaatagtaaaaaaaaatttggacatagctgtttgaatagtgataatgatagtttaccatagtaaaatttatttttattttaatttttaattattatgggtacatatagttgtatatatttatgaggtatgtgtgatattttagtacagacatacaatgtgtaatgatcaaattagggcaattggggtatccatcacttcaagcttttatcatttctttgtgttagaaatattccaattctacttttttagttatttttaaatatacattattgttaaccatagtaaccctatagtgctaccaaatactagatcttattcaataattttttagacagacatactaagaggaaatttttaaaattcatttctgtagacttgtcaaattgcggatcttggagttaagagaaaatcacttgaaaactctaccaaagtaagtgactgtgtattttctgaattttgaactgtgatttttttcactagtaagagaaataactacttttattttgtctgtgttttggcactttgagttaatttatctacacatttttcctaaaggccaaaaagtatggtatactgtaaaagattcatattacatgagaatgtattctgttttataaaactgtaattacaggtaaaggtggaaagagttcacttaagtttcttctcatggctgaagatacatgccagaaaagtattgcactaaaacatatgaaattgtccttcttatagctaaaaacaatagtgtcacaaggttcaacctaataggatgcttaattcttcaagttaatttatggattgtagtgtatctttcagtttttacatcaagaatatgccagaaatttttaggaaaaaagattaaaatttttcaagagatcgtaaagtggtttaggtagaagttatatattcttgcaaattgttcatttttactagtctatttaaaatttggcttacataaaaatataggatatattttaaagtaaaaactaatccttaaaattttatgcaatgtttaccataataaaatgctttgtttcacccagctttgccttattcatgtgtaacaatagaattttatgttttacagttaattatttttgaaagtcaaaatgggttttttactcaattaaatcagtataacttgtatatgttatgatgaaaatatttaaagtactatgttgctattatcacccttctgcagtattatagaaaaatattgagtacagtgaataattttttaaacatttcagtaggacttagattcatctgctgaaccaaaatgtaaccttattttttacttattaaatccttttcctaagcaaactggattgactaatatttcaacaacataccttcaagtgcattttatgtatgatattgtgtattaaaattgtcattgcaatataatgccacaattatgaaaataactttcaataatgatatggatttaatttgaatatatacataaagataaaacacctccttaatcctccataagagaagacaaggagagagcatagaaatgaggaaatgtctgcatatttcaccatcctgcacttttgaattatgcctttctctaagctaaagcattgggtatgggcctaacccaaggaacccctcccaggttgggggcataaacaggttgaaatatggttgagggtgttaatcattcaagtggaaatttcctgcaaatgcagctagtgccactgagtccatccctgatgcttttgtctgccacatttaaagtaagtggaaacatggctaactggaagctaaaccaagatagaaaagcagttgtccccttcacctaaatatatacatttaggtcaaggaaaaaatattgagtatgcagaggagaatcattttccctctgttctcaaataatggctttcatttgaagtacaaaataaacctgacataggttgttaggttttcaaatatatatctttaaatatgaattttaaatataaattaaaacctgatatagattgataatatggactttatatgaaatagctgtgtgaataaatcagagtaatgagaaacaataataacaacaataattggtgctggggtattgtgcaggctttgagattgtggcccagtattaaacagaattaaattaagtagaataatatgcataaaccaatttggacatagaaaaatgttgtaaagatatattagaactgatgttgggtctctttgatagactcatacacatataacttatatagctgttacagcttttacactttaagaaacattttcaaagttacttgcaatctagtgtgttcattttataactcacaggccaaaatctaaagaaccaaattcaggcataaaatatagataactttagttttgggtctatagaatgagaattgcagaaagaaattcttctttgaataaaaataaactttgttttcactatgtattataccttttgatcaccagtctatacctcatgtaacttaaagctacacgagagcattatagtatcctttattttgcactcccaataaaaataaaggtgaaaacatagttttaggaaaaacaattttagtttaacaataactattctgagaagagataactcatgatttccttagggatacaaacaagatgttgcattgttagttattttctcttcttttcatcttttaagtttatatgcttagcaatctgtgcaaaatgtgattgtgtgcaagaatcataatataacatacatgaagatgtacatcctttaagcaaactgatggagactcttagatgtatgcaaattctaggataatttttttcagttacaaaaacaaattagtattataagtttccttataatgtttatgatcattcctctacatacatcaaggagtaataaaactaagtcctttggatacacatttgcctaaaactcattgaaatagtcaagtcttgattatttgtaataatagaatacagtgaacttctgtaaataactagattgccaaaaggaaaaaatgttagattatgtgatacagtttttccttacacaagaattatcttcctaattgtgttttttgagggatagtcagaaaatgtgtagatggtagagagaattcaaatgaatgttagatgtcaagggaaaaccaagcctttgtttgcttatttgtttgcttatttattccttacttcatttgtttgtgtaagagtatctcagggttaggaattaaagagaagctagattctcggtgatgctgtctcagcgtgtctcatgaggcttgaatgggctagggtttgcctcaaatctcactcaaatggtggttggcaaatgggtttctcactggtgatagactggaagctttccattcttttcctatagaagctcaagtgtgcttctctatagggctactctcaatgtggctgctcgcttccttctgagcaagtgatttgagagagagagtgtgcatctaagacagaagccttggtcttcttataatctaaactcagaagtgatgtactatgatgtctaccatatgctattgatcacagagaccaaatctggaccatttcttccaaagtatggaagaaaacaacgttaagactataaataccaggagacagggattaatggagtccattgtagaggttcctaccacaggtctggttctcagcattgctggtctagaaattcaatgctgacatataccaaatgcatcagatgcagaaggccgatgcacacaatataaaatagtctcccttcttctttataccatttcattattgtgtttgattttcatcatagcacttaccgctctctatatgattttgactctttgtttacttggagattatctcctcaagacagtatgagtgccattaatgaaagattatttccaattggtcactgcggactctccagtgccttaaacatggtagacattccaaaccagaatgctgagctatggattcacaatgacaagtatctgtcatgtgaccttgacattttgcatcacttgattatttttctccacagaaaattatatgggaagccaaacattataatcagattagtcttggagagcagcatgaagtcagacaaggacaaatgattgagctttctcaatagctgatagcccagacttggattttataaacctacacacattttctctctctctagatggtttcaagttaggcataatagttaagacatgacagggagaaaaataacttcatataattaatatttataacaactaaataaaatacaaaaatagtataactgctttttattaaaatgtgtcacatttcatcaagaaacaaaatatatgtcaagataaaaatgaagggataaaaacaattttttaaatgaaatttagaaattttttccacagaagtaacataacatcatataaatggttggtaataatggtgggttttaactttaaataaaactgttccatgtgtgtgagaagaatttttctaataccgtcaagttaaaataaggcctcattcattaataatttatcaaggccaagactaactttgtttcaactagagttaaaatatattatgtaaatgcatgtgttaattacgaaactatgaagtaatatgaagaaaaagaaacataaattaaggtaacatgaatattcatgtctcctgatgcacaaggcatgaaacatgatacctcactttgctgtcatatacactgactaagagaggaatgtttcaaatatattccaacagaattactggggtaatatcagtaaatacagtaaaacctgatgaacatattcaaaattgggaaagtggatggatttggtagatgaagaatgctaagagttgttggaagaagttctaagtggaaagataaatctgaagtaatgacagtatcttttgggtcagtgacccttctgagaatctgaaaagagctatggaatatagaaaagtattaattctaaaacgcaagttgtatctattttcagtatatgaataacctattgtgaatatacatgttcttattttcacctagaagtagactattttgccttttatgtaaaataagccacatcaaaatacctagtattggccaggagcagtggctcacatctgtaatcccagcactttgggagaccaaggcaggccaatcacttgaggtcaggagtttgagaccagcctggcaaacatggtgaaatcccgtctctactgaaaatacaaaaagtagctaggcatggtggcatacacctgtaaccccagctactcaggaggctgaggcaactgaatcgcttgaacctgggaggcagaggttgcagagatcatgccactgaactccagcctgagcaacagagtgagactccatctcaaaacaaagcaaaaaacaacaacaaaaaaaaaacctagtatagagcatcaaaaagagggacctcccgattttaggaatcaaatttgtcaaatggataattttagtcatataaccatttctagtatgttcattgaagaagatttttttaagaagagaatattttattgagtaaattttatttcgggttgttaataggattagatttcattatcatctgtgaagttttttaatttcccatagtagaaattattaaggaattatttaagagaaaaattttccgaagtacaagcataaatgatacttttaaactactaaactatatatgctagatatctcgtaaatggtgtatctattatttatatgattttatcccttgggcatcattgcttttattaagtgattttgcccctgaaaacaaaggttcagaaactctgtagtaccacctttgtgaatacccaaggacatgtacacaacataaatatactcacagaagatgccaatacattaaaacttaactggacatactcttccaaaaagattcactttaaattatatatgtaaattaaagccagagctacaccgacagctgcacactgttaaggaaagatattagatcatgaaagtcaaaaaagactaagggactattacagattcaagaagactaaagagactaaaataaatatcattctgaaccggttcttttgctatagaggacatttttgagacaactgacaaaatttgggtttgaagattagatggtagtaatatatcactattaatttcctgatttggttggttgtattttgatcgtgtagaatgtttgtgtgtaggaaataccgaagtatttgggaggatgggacaccagattagcggtttactctcaagtaattcagaaaaacatgatttttagtttttaaacatttttgtaattttataactgtttcaacaaaaaagtcactttattttttattgtgttcttcaatttcctttttaattttttttatcgtggtaagactacttaacatgagatctaccctcttaacaaacttttaagcatacagtacagtattgttagccataggcacaatgttggacagcagatgtctgcaacttgttcatcttgtataactgaaactttataccaattgaacaactccccattccctcctcccctcagcccctggcagccatcatttgatgctgtttctgtgagtctgaccattttagataccttgtgtaagtggaacgtgcagtatttgtccttctgtgattagcctatgccacttagcagattcacccatgttctcacatatggcaggatttccttcttttctaacgtggaataatattccgctatatacatacataccacattgtctttattcattcatctgttgttggacatttaagttgattccatatcttggctactgtgaataatgatgcaatgaacacgggagtgcagacatctcttcaagatcccggggtgagttcctttggatatatatttagaagtgggattgctggatcatatggtagttctattttaaatttttttaggaaaccattcactatattttaccatactgttttccataggagctgtaccattttccagtataacaaagggaacataaacatgtgttttagaaatatattttcaaagataagttccttaaaaataaagataaaaacactttcaacacagataaaattattaactgtatgaaatatttgtcaatatataggttaagagaagaatttgcacttccatactaaaatgctaaggccatgaggcctatagttcgagcactttgggaggccaaggtgggagaatcacttgagcccaggagtttgagaccagcccaggcaacagagcgaggccctgtctctacaaaaattttaaaaaagtagctaggattggtggtgtgtgcctgtattcccagctacaagggaggctgaagtgggaggatcacttgagcaaaggaggtagagattgcagtgagctctgatcatgccactgcactcaagcctgggcaacaaagtgagaccctctctcaaataaataaataaaaggcttaaatatgtgtaaaaaacagcattttagaagtaaaggttctatccgtatgtgactaatatatgcactgtggtttttttcctaacctgaatggcaataaatgctacatatttataattatcactcaaatttctaaactattcatttccaaatactatgttttatttttcatataagttcatttattcttttttaataagattactccatagacagacttatctaaaatataatagatttgttatgttttctttttttaaaatccttccttcctttgttatctagtttactaccagttattatcaaaataatgaagaaagctcatagattaatatgtattcttaactggacaggtgtgactaagtcatgtttccattctcatttcagtgttctattaatgaatttatctcacttggcattatgctaccctactagctattttaatgaaatacatcaataggttccttagtgccattgtaatgaaaattccattgtcaaggacagcttacagaatggctttttgatgtttctattaactctgtatttgtaattctgttttgtaactgtaatacataattggatactgtgtgattgtgtaatcatattaccttacgcttttaccaatttatatcaatttacaaggtacagtgtttttgctgaacccatggtaccatcctcttcaggattatctttatcaaaaccctcagtttgacaagctaactaaccaagggaaaccacattagtgccctctgcttttagagaattatacatagaaacagatattttctttacttcttctcacttggtgttatattttcaattcaaatgaaataagtggataattatgacattctatatttaaaagtattctataaattataatgcattataacaaagtgattattagagtcacttctaaaatatcaaacatatgctttccatagactcacaaagaaaacactgagttctgccttgtgaacgaattgtatttatttttaaacttatactctcaacacaaaattaagaatgataatattatggttagctaaggctgtggcgacaatgggaagagcttggaagaggtcacaaaaaccaagtaacaccattgtattcaaattgctcttttcagactacttcaaacaatagctactctgatccctgatgattagtttaccaaaagataaaaactgcctgcagtaacagtgaggctgaaagcactcagcttcagttttataagatctcggaggcttagtctctagtggaacaattagctcacactcttacttctgtttcgctgagaagagctgtaaagtacttgagtgggaatgtactttgcagtcaaaaggcccttgttgcttgtttatgggttatttaccttctttgaatctcaatgtccttatttgtaaagagtgctggatatcattacctcttttaagctgggaaatatattttgggtaagagttgatgaaaataaggcttattatcatttagacccaggaaaaattttaaataaatttagtatacactggcacttagaaaatctgggtgtgtgcaagaaaagattgacatgagttctagatatttttcattttatctcataaaaatatctttatcataaatgaaataatgttatttttagttttttataataaattcttaaaaataatgtgtgatgctaacgtgcctttcttacttcaccagcagtactctagtgaaaacttacacaactaattttctgtcattctcaataaaaaatatagaaaatgtttaactaaatgatctagttattaattcttaatgactttttgcttttaaaattggtagcttctttaggcaaatattgaatttagcaactaaaacacgtgatagaaattaacactccacaaggattaggaaaggcatacatccattgtttgtatcttcatgtatcttataaattcattattgtggatttttgttatatcctttatggtttctaaataaatgtagtatttttcctaaatgaatgttctgaaacattatactaatactgacttttgtctcagtgtctcaggccagaaaatacacaaacaacctagttaacagatatattcctgtggtctcaggtattacctctgtgctgatgagcagcaaacatttatttctaacctgaactttttacctgaattccagttccatattccagtagccaatatcaaatggaatattcaccacatgttaacatggaaatcatcctccttgctcttttccacccaccaccgcataacaaaaccaaacttggttaaaccaaatcaaacagaaatcctgtttcttattatacactgcctaatgacagcactacccacagaatcacagaaagtagaactatccatctcattttcctctcctactagccccaaatcactagccatcaacttatgtcacatctgagcatccttcccctcccacattgttgccctacttgagtttcttaataacgcttgcctgtgccttcaacaattcctcccccttctcatctctaccattggaatacatcttccttattgttgtcagagctttcttattaaaacataccaaggcacatgtcaatttgaaagtgcagaatgactgctcacagctttcagaagacaaaatgtcaagaattgtcatagcttgaagtcaacatttctggcttcgttgcctcccaacactttcacaatctcacgaggtttctgctacatccaatatacaatgcacctttatatctcgaagcatctttcttgagacattccctttttctgtctgaaaaactccaaattatcccttaactttcccaccactttcaccatgaaattagccatagattttgcattctgagtggtagcttagaaattcttcttgagtttttgcaaggcaaagtttccatgggaatttggatctaattatagttttactcagaaatataataagcttaattctgtgagggtttttttgttatcttgaatatattagctgaagctgtaactccatggttcaactgtcaagtaagcaactgctgagcagtgtgctttccctacccaactgcagattttggaatggcacagtctccgcagcagtggacacataacaggtattgagggactgattttcaccaggctctcttctatgatattttggtaggtgcacaaaaaaattaaaaacaaccctgaatttcatcagatatattttattatagcatcttgaaagatttccctaccacctatgctttgatttttacttttataaaagacccttcatgcataaacaacaaactaccccattattgatagttggttcaataagacacaccaaatccgctgaaatgtatctaactctccatagattttctgctttcttcaggtctcctctctcctctctactcaagtcagggttatttcaggtctttcaatatgcaaaatacatctttaaaaagctcgcttttctgtcgaacagatgcaagggggaatatttctaaattgctatagtttgccacagtttctgtgacatttaagataagtggctgagcaatattaaaaataaaaattcacataagaaattaacttcatgatattaatttctttagatgtatattttatattttcttttggcaatatgaggttatagtttgtcctttcatggattttaaaaaaaatcattttcttaccaaactaatttttccattgtgtttagttttatattgtttatattgcatataccccaaacctttacctaactactttgcatttctattccttttgctttaaatttagccttttcccataactttaataggactcctgttcacatttactacttaacagcaatcttttctagttataaaataaatgcactataattttatgagcaagattagaaataaaattagattacaaagctatgaatcttatcaagcattagctgtttacatttatgttcattctaaaatgatgagatagaatatcttacactataggaattggttaaaaagtaggagcattatttaggaaatgttcagtggcactgtagataaatgaattattttgtattttaattatagtaaaaagtcattaaggctatctattggctctggattatactgaaatacatctaaaaaaagcaaaaacttcattttgcttaaatgtttcactgaattttcagaagaaaatggaacagcatttcttatactaaatataacttaaagagcatcttttaaattattacttccatctatatggatatacattgtaaaatataaaacacattttaaaatatatgtattttaatatatatactttagttttataaaaggaacatctaatacctaaaagctttactttagagagaatataaaatgaaaaatctttggcttccttttgttcatacaataacatctaaaccccaaaacatggcattccaggctcttcacaatctgaccccaacttttcctcctaccactgcctacttaattccctaaatatgactcccaagtttgtgcctctgaagacatactgataagttctcactttatatagtgaacaagtcagttaaaaataactttaattgatcatgtacctaataggtgtcagacactattctcagtgccaaggaatctaacaattttccactgttcaatgaatttcaagtgtggtggaaggagacagataataaaatataaacaaataaatgagtaagattggtaactgctatgaagaacacaggatgatgttatagagagaggtgggtttttgagggttcatggggatgttgggtgatttggggtgggggttggtttttttgtcgttgttttttctaggctggtccagaaagacctttatgaacaggtccggtttgcatgtagatttgaatggtaggaatgatgaagttgtaaagaaagagaaaaagcaaaaataacaaccaaagaaaaaaagaagaaaatcaggtgtacaaaacttgtgatggcagcaagcttgagatgtctaagaagcacaaggccagagtagttgaacatgcccagtgcaaggtgaaggaatgtgaaaggacagtggggtaaatttatgaactgccttgtgagccatgttgggaaattaggattgtattctgatcataatgtgaagccatggagacttcgagcaaaggaaacatgtgatttgatcttagctttacaatgaacagtctgacttctctagagagaagggattttagggagacaacactgaaaaacggacaccaatcaggagatgattgcaatagtgaagatgagtaatgttgatgactttgtctgagattgcagttatggagacaatgagtgggaagatttgtgacccattttggaagtaggtccttgctgatggacagaatgcgtggtgaaaagaaaaagtaggaaccaaggcacatttccaaattttgggtttaactaattggatatggtgacacaatttcctatatagagaaactttgaagagtagtagatgaggggaattgggaatttgatattggcaatggaaagtttgagatgtctattaaacaatcagctgttggtggctagatacataaatcatctgctcagggagatagataaatttaagagtcatcagtgtatagattatatttaaaattatgaaactctttgaagttattgagggagagaacacaaatagagaagagatgaggagccagatttgagcttgaaacatttatagtttgagcatggaaaaggagcctataaaagattatgagagtgagcagccagagagttaagaagaaaaccaactgcaggtagtgccactgaagcctagaaaaaaatgtgagagggaggagtcaattgtaccaaatgttactgagaagtcaattaagaaggaaaaagaaaactaagcattggcattagcaagatacaggtcattgagaggagtttgataagagctattttagtagcgcattatgtgcagccttattagagtagttgaggagaaaatagggattagcaaaaagagacaacaagcacaatttcttccattttaactgcaagatgcagcagtgcagatgtcagtaactggacaggcacattgcatcatgaaaaggactttttaaagatagatcttagtggagcatactagcaggctgatgaaaatgacccagtagaaagaaaggaattaatgatgcagaagagaagggaaataattaccagaagaaatgcttgaagaggtgagggaatgggatgtagagcacaaatggagaagatgtccgtagaagcagggactcttctaacatggaaacactggtggcccgggagtggaaagataaaaacgttctcaactaatttctttgatgttctctataaagcatggagagtcataacctgagcacaagtagaaaatattagaggtttaaggagacaagaaaaagcatgaaagaactctgagagtgggaaagttaatggacaagggtggtgtcctagaatcttctggcggtgttgaccacctatttgtgatttcaggttatatatttgaagaaaatccagtcagaaaagttaggcaatcttcttcagaaagtcagatactttgcaagcatagaaggagaaagccagacagctggagtttaccaaattagccagatggaggaggaggggacaaggaaacataggttgtttatgggatagtgactgggatctagaactacaaaatttaagatgggaggtaaatgtgaagatatgaaaaggtcaggaaaaaatgttttatttgtctttctctcctttttgatataccgtaagtctttaaagtgcaatccaaatgctactctctctacaaagtgtctcatgacacctcaggcaaacaattattcttttctctttgttacattgccttttgcacatttctcgatgggagcatttttcacattatgttgaatttgttgtctacgtgtatatccccaagaagactgtaacttgtaaagggaaaaactacatatatcttattcattcgtctttattttggcaacaatgtggggcatacagaaggcttgcaaagaacgtttacaatgtagtatggaaggaagtgctttagtgcctagactcatgccaagcacttgatggaatcctgtgagtacttgactgattggcaggaacagaaatgaataggaagttaagctctgtgatattttcttatacaacatctggctcttgattattggaaacttaatgactcaagtacaatgttcattgtttatctttcttctcatttcacttgcatacctatagccattacatccatcactatccttggcaagagttcactgcagatgtcaaattgttttagtatcttttgcttttttaaaaatgttggcaatgtaataacatggcttaaactgacacttttcggttatatgtggactttatttgctttcttaagttagttaattgaacatattatcaattttaattgaaaaaataaatatcaactttgggtatattcttaggtgatgtttccttataggaaaatttgttacagtacattttagatggaatgaatttccataacattatgtaaaatgaaaatgtgttctaaagaaagaaatgatgaagaagttacagtgtattgtaaggcaatatggccttttctagattgccaaatattgttgcctggtgagcaaactgtgtaaaacactttgtatcagaatgtccataatgcaactataattgctataggtagcttttaccaaagcttctgtagcatactaaatgcatcatgcctgaaaattttacaaaatctttaagtcatccctgatgcccaaatgcagctactgtagatcctccttataaagctgatattgtgagaaaaaaactaataaattataaatactatgttcgaatgattgatttatgatttatctaaaattataaaataagccatattttactggaattctgttctacttgagttcttaataagaaattagcaccttccatttgtttctctttttcctttctttcttttttttttttttttttttttttttgagacagagtcttactctgttacccaggctggagtgcaatggtgtggtctcagcttactgcaacctctacctcctgggttcaagcgattctcctgcgtcagcctcccgagtagctgggactacaggcatgtgccaccacaccccgctaatttttgtatttttagtagagatggggtttcaccatgttggccaggctggtctcaaactcctgaccttgtgatccgcccaccttggcctcccaaagtgctgggattacaggtgtgagccaccgcaccctgcccatttgttcctcttaaataattttaaatcatttctgatagaaaatgttgcatttgaaatgttttagactgttgcagaaagaaacgtgaaagagtctaatgcaagatgaaggcagagctaaactcagcaaatggtaggagaaaatggatgagaaatatgaactcagctgatttagggaagcagacagctttttccttttataataacaatgagaaatctgaaatccttgcttcggttgtaattcagtcacttatataaatattttccagtgtttatattaagtataatgattagcattcaatattggttcataagtaaaatttactaccttgtaaagcctggcagatatttcactgataaagttttgaatagatgatacagagtctcattaaattatgattatgtttgttagtcccagtttatccacagaataagcattaaataagtaaatcagcatagttccaactgtggcctgttttttagttgagatccttggatatatttgaaacaaggataattaacttctctaaaatttcttttcttgttttccatcatatttttccatctgtagttttaaatagaaatgcacactgattcttcacccttgtattactaaacaaataagatgaaacaggaacatggaaccaagcacagtggctggtctgtaatcctagcactttgggaggctgaggtgggaagatcacttcaggtcaggagtttgagactagcctggacaatgtggtaagatcccatctctacaaaaaaataaatttaaaaattagccaagccttgtgatgtgtgcctgtggtcctagctacttgggaggcagaggcaggaggatttcttcagcccaggagatgaaggctgcaataagctaaaattgtaccattgcactccagcctgggcaacagagcaagaccctgtctctaaatttaaagagagagagagaagcaagattttgaattttttggtaatgataaactacctatttttaaaccaacttactgagggtaacttgatccaaggggaatccagatatccagatatctttacactctcatatagaatgaagttattacttgaaaattatatagtaaaaatgagtattcctttgggggaaaaacagctgttagatgagctgttccaacagtttaatagcaaaattaaaagtattaaaatctaatacaaattttaaaaatatgccagcatttttaaaaatcaacagttctactggtgatttttttaagtttacaaaataaaatctggattcattttccttaacttagcctttggttccctgcctttagcagaaacatcatggcgaagtgggggggacctgggctttagagtgcagcaaacatgattccaaatctttttcaactcttaatactttcataccttagagcagggcatttagcctttctgatatgtattatgtatttaggcattatatgtaatatgatatatgaattatacccaatattttctttacatggttgatgcatgataaatgaaagtggttgttaagtttgcagagggaaggagcaaaaatgaagccaaaagaagcttctcagaggttctcactagtgtagtagtccttgcttaagataaaaataaatctagttcttttaatggtgatgttagggtgtccattttagatctttcctgctttgtcttgtgggcatttagtgctataaatttccctctacacactgctttaaatgtgtcccagagattgtggtatgttgtgtctttgttctcattggtttcagagaacatctttatttctgccttcattttgttatgtacccagtagtcattcaggagcaggttgttcagtttccatgtagttgagcggttttgagtgagtttcttaaccctgagttctaatttgattgcactgtggtttgagggacagtttgttataatttctgttcttttacatttgctgaggagtgctttacttccaactatgtggtcaattttggaataagtgcgatgtggtgctgagaagaatgtatattctgttgatttggggtggagagttctgtagatgtctattaggtctgcttggtgcggagctgagttcaattcctggatatccttgttaactttctgtctcgttgatctgtctaatgttgacagtggggtgttaaagtctcccatcattattgtgtgggagtctaagtctctttgtagttctctaaggacttgctttatgaatctgggtgctcctgtattgggtgcatacatgtttaggatagtcagctgttcttgttgaattgatccctataccattaggtaatggccttctttgtctcttttgatctttgttggtttaaagtctgttttatcagagactaggattgcaacccctgcctttttttgtttccatttgcttggtagatcttcctccatccctttattttgagcctatgtgtgtctctgcatgtgggatgggtgtcctgaatacagcacattgatgggtcttgactctttatccaatttgccagtctgtgtcttttaattggagcatttagcccatttacatttaaggttaataccgttatgtgtgaatttgatcctgtcattatgatgttagctggttattttgcttattagttgatgcagtttcttaagagcaaacacattcaaaagctagcagaaggtaagaaataactaaaatcagagcagaactgaaggagatagaaacacaaaaaactcttcaaaatatcaatgaatccaggagctggttttttgaaaagatcaacaaaattgatagaccactagcaagactaataaagaagaaaagagagaagaatcaattagatgcaataaaaaatgataaaggagataccactactgatcccacagaaatacaaactaccatcagagaatactataaacacctctacacaaatagactggaaaatctagaagaaatggatgaattcctggacacatacaccctcccaagactaaaccaggaagaaattgaatccctgaatagaccaataacaggctgtgaaattgaggcaataattaatagcctactaaccaaaaaaagtccaggaccagacggattcacagctgaattctaccaaaggtacaaggatgagctggtaccattccttctgaaactattccaatcaatagaaaaagagggaatcctccctaactcgttttatgaggccagcatcatcctgataccaaagcctggcagagacacaacaaaaaaagagaattgtagaccaatatccctgatgaacatcaatgcaaaaatcctcaataaaatactggcaaaccgaatccaacagcacatcaaaaagcttatccaccatgatcaagtgggcttcatccctgggacgcaaggctggttcaacatacacaaatcaataaacgtaatacagcatataaacagaaccaaagacaaaaaccacgtggttatctcaatagatgcagaaaaggccttcaacaaaattcaacagtccttcatgctaaaaactctcaataaattcggtattgatgggatatatctcaaaataataagagctatttatgacaaacccacagccaataacatactgaatgggcaaaaactggaagcattccctttgaaaactggcacaagacagggatcccctctctcaccactcctattcaacatagtgttggaaattctggccagggcaatcaggcaggagaaagaaataaagggtatccaattaggaaaagaggaagtcaaattatccctgtttgcagatgacatgattgcatatttagaaaaccccattgtctcagcccaaaatctccttaagctgataagcaacttcagcaaactctcaggatacaaaatcaatgtgcaaaaatcacaaacattcttatacaccaataacagacaaacagccaaatcatgagtgaactcccattcacaattgcttcaaagagaataaaatacctaggaatccagcttacaagggatgtgaaggacctcttcaaggagaactacaaactactgctcaacgaaataaaagaggacacaaacaaatggaagaacattccatactcatggataggaagaatcaatatcgtaaaaatggccatactgcccaaggtaatttatagattcaatgccatccccatcaagctaccaatgactttgttcacagaattggaaaaagctactttaaagttcatatggaaccaaaaaagagcccacattgccaagacaatcctaagccgaaagaacaaagctggaggcatcacgctacctgacttcaaactctactacaaggctacagtaaccaaaacagcatggtactcgtaccaaaacagagatatagatcaatggaacagaacagagccctcagaaataataccacagatctacaaccatctgatctttgacaaacctgagaaaaacaagaaatggggaaaggattccctatttaataaatggtgctgggaaaactggctagccatatgtagaaagctgaaactggatcccttccttacaccttatacaaaaattaattccagatggattaaagacttaaatgttagacctaaaaccataaaaaccctagaagaaaacctaggcaatactattcaggacataggcatgggcaaggacttcatgtctaaaacaccaaaagcaatggcaacaaaagccaaaattgacaaatgggatctaattaaactaaagagcttctgcacagcaaaagaaactatcatcagagtgaacagacaacctacagaatggaagaaaatttttgcaatctactcatctgacaaaggactaatatccagaatctacgaagaactcaaagaaatttacaacctgcacattgtgcacatgtaccctagaacttatagtataataataaaaaaaaatccacaaagacaagggccatccaggctacaccaatattagcatactagaaggtctctttctctttttcctttcttgtttcgctttttcctttcatcctttgagttgggaattgtggcaggacctctggattcaaggtttaccatttctgaccttgctttgcctgctttgcttcacagtggcagttacacagcaggatccagatgacaactgctcaggaagtcagaatatttatatcagaatcaactcttcctatccactaaattatgagtcataagatatttgctctaaaatgcccatggtgcttgtgctcattttgcatttcctgagttatctgacctctagttctcaaggaatggtcttttgagtctttttatttatcttggtaacctcctcaatgcctagaatcttgtctctagagacaaagaagtcattacataatgataaaagggtcaattcaacaggaagacttaacaattgcaaatatatacgaactcaacagcacagcacctaagtgcataaagcaaatattgacagatctgaaaggagcaattgacagcaatacaataaatttcactcttaaccccaggtaactgatcaggaattgaatgtcactattcataaacagaaataaattcccctaccgcctctgcccaaaaaagtttgcatggatctagaacccaaattgacttcttcatatacaacttataatgttgcacgttttcactgagtgtgacaagctgtgtgtcatctgtgtatatgagaatcatattaagaaatgcattagaattgagagtcttgattttttcagcaagtagaatgaagactaattttaatacgtctcattttgaagacagtaagtacatgcatcatgattcctgaagtttattcaacaacttttctagcacattattttggcatcacacacctatatagaaggcttactatataggtggtatcaaagctttattacattaatttatgatcccaaaatccaatatgccattgacagagagctaatttgaatattctttcttcctttgtcaggtagtgaaggtttttattattagttgatccaagagattttattcccttttattttgctctgatggcaattagcaataatggattctgatatatatttaagtccatttcttttaacaggtgttcattaatcacctttggggaagcttttcttagctaaattgtataaatttaaacgttaacctttctgtaaaggtaatgcttttgttaagagctaacaaagttgagaaagaaataaggaattcaaaatagtgaaaaaaagtttctcaaaatgacagtatgatatgttcattttgacccattttaaaaccaacaagaaaactttcctagagaacttactcaaattaattaatttaggttttaataatatgtgttaatatttgtagaaattatatcaatcttttagtattagtaagttaaattgaactaagtgatgtgatttacactgaatatctctatttctactacagccaacttacgatctcaattctcttttttcccagtggtttccaaaattcacaaaatttaattcaccattctattcctattatgtttttctttgtttatgcacacatcaatactctcatcagggtttttgtttttatttgttgttttttaaacttttaaatgtttaaaatagctgaaatatattctttgttgaattctattttcctaaagagtcagctggcattgtattttttgtttggatcttttttttccatgttgcttggagaatctcttcacctcatcatttctcagtgctttatacctgccagatactaaagtactttatatgtattaatactttaaactcacaaagtataattataatataggtaccatgatcagttcccattttatagatgaggaaaaaaagacttaaggagactgagaaacgtgaccaatattgcacaacccttaaaggtggattagggattcaaagacagatctgtcttataaatctgagtagaaataacgatgagtgacagttatattctttgctaaccatatggccatactatgtacacttagcaaatctcaggcctaatatatactagaatgaataagaatattttataagatgattggaaataaaatgagtagattaatatcaataggtttttttgttctagaaaaaaagcattaatgaaagaaacagaaataaatattccattcactagagcaacaaaacctatgtaatatttaggaataagttttacaagaaaggcatatgcttctgaaataaaactataaattcttattgaaggacataaaagaagatttgaataaatgaaaagacatacataacttcttatatggaaagatttaatatgataaaagtgttatctcttcccaaattattcattaatgaagttaaatatttgtctaaccaactttccttagaattccaaaggcttttaattaactgaaataatcttagagtttataggagacaaaatacattataggttatatatttgggtcacttgaggctcaggtcaaggagagaagtaagtgaaagagtgtgagaaagaggaggaaaacactctcattttataagtataattgtaaaaattaaaattacaaagaaaaagcatatatgaaataattagttataaatttatgaaagttatattttaattttatgtatatacaaagcatttttaaatagaaaagttgaaaaggactgccatttaattacttcaattgctattggcaatttgtaaatttttgcattcttatctgccacatcattaataatgttcatatttttctagataatgttcacagataatgttctttagataaattcagcaaatggtattcttaaacaattcagcagacacaacttaatatgaccttgtttcaacatattgatttagaaaaaggagaatgttagtgaaaaatattgcagtggtgacaaaagaatatcaaatacttcttaatggattttaactcctaaagagtaacagattcaatctacattttgagtcctgctgaacatgacaagcaatttaacaagtccagcctacagagacataggagcagaaatcagaccaaaaaggagtaacctcgcaaacagatctgataaaagttgagttcatccaaggaggtagaaaatcaagttcaaggatatatgctagggaataaagtgttaagctgggccatagaagtgaaacagcaggattcaggtgtccatacaggtgtccaactagaatagccgtgacagaaaaggctaatggagaatcttaattctaaaccggaggctctttgctttatgccttataccccgcagtgtctgtgtgtggcggacctggaaatcacaggtgttcttgcagttcaaacagagacaagtgcctgtcaggccctacccacacttcataaaatcagttgctacagtgtagctttctggtactttttaaaagttatcagaaaaacagggtaagtttatcaggtcaaattacttataattgtgccttctctgttgagataattcttcagatccacggtagctgtgtgtcagggtagcagggcagtctctggcttgtctgtacacaaagagcactgtctagcttggatggtcattagcacaccacctttcaaaattaaccacaaaagtatccttggtaaagaagtctaatcatcacccttctcatttataacataaaagaaaccatctatggcgcaagataatattgaaaaacatttgcagtaaactacacaactctcagccagaccctcaagtccaggttgaacgtggaaaactggtagtgtgttcttatagatggcatatagattattaggatgagcaaaaatagagagtgggatcttaaaagaatcaggcttctttcaaaggaaatgaaactttttataataaaatcaaaaattaaaactgagtattttcactgattattatagggaggagtacagtaaaagaccccagatattcagatttctgcctgggaataattagtcctggacaaagcctaccaagaactaacagtcatgttcccttcgaatgtccactttaacagaaaattctgaatcatcagaacagagtctatttgccctgaatagctggaagtatttggaaaattttcagcaaatgcagttaactaaagatattgccagttaaagagtttcacctagagaacattattgtaataattttttagagtcattgttcatatctttttttattatattttagttctggggtacatgtgcggaatgtacagttttgttacatagttatacgcatgccatagtggtttgctgcacccatcaacccgtcacctactatccctcccttagaccccccacccccaaacaagcccctgtgtgtgatgttaccctccctgtgtccatgtgttctcattgttcaactcccacttatgcatgagaatgaaagaaagtatattttagaggtgagttatcatccatgtatttcaatgcatcacaggtgccttaaagtcaagagtttcagtattgaattcatcatttacatcactatctgtacttttttcagtatctccaagctcagttaatagaaataacattttttagatcctatgaatcatcttaggcctatttcttactcccacatctgatcagtcaacaagttctgtcaaatctgtctatttcgcttattcatttccttctgtctggaactctctgcccccagaggctgactccttttttatcatttaaatctcaaatcaaatgtcacttactgcaaaaggtctttgatgaccctccaatctaaagtagccattccaaccccaggcaccttccaaaactattttaatttctatataacactggttaatattataaattctcttattttttacttgtctctctcattttaaaaacttgtccttgagaacaggaatcttgcctagcttgtttatctctgtatccttattgcctagtattctgcccagtgcatggtatgcattaataggttgtactttttaaattcattcattagagcattatttcaacaaatatacttattagacatttctatgccccgcattgtgttaggcataggaaatatggtaatggacaaaagtaaaccctatctttgtcctcatgtagcttacatttaatcagagagacagacattaacagaataactacataaataaatgtaaagttacaactatgagtaattacttgtttctctcaatctctattaccattgcattagttcaggttatcattatctcatgcctcaactgttaaaatcaactgtttctctgcctccactctgccacactccactctgtttttccaaagctaaaatgcaaattcaatgtcactttccaccttaaaaaccataataacttcaatgacattcaagaaaatgtttctacactccttaagataatggcccttcatgacctgcctatcatctatctctcctttctctcctcatgctgtatgcttcaatcaccctaaattacactcttatcttggggcctttgtatatgtcattccttctgcctgatacgtctttttctactctttgattaacttacctacttatcctttatggctcaaggaagaaaagctctttcagaaagccttttctggacccactcagactggctctgccatccctcttatgtgctctcttagaaaaaaaagaagaaaataataataatttcattgtgctagaattgtttatttatttgcttgtttcccttgcaggtctatgagttcccttatggggactcacagatagaaatatgaatgtcttttatatttctatctccattgcctagagcagtagcaagtatgtagaataaaatagttggaagaatagttggatgaatagatggatggaggaatttgcttgataaaactaaaaacaaaagtctataatgatattcaacaacacagcttcaaacatgtactattaaaatatgtgtgaaaaagcatattggccagaagagaaggctagtgaagcccatttggatgtttcaaatactgtgacagtcagcactcagtaatttggtcactaaatttatttcatgtttgttaatgttaagaagagaacattaactatccatagccctgtatttgaagtgtcagaagatagggtaacatggcaattaaatcagcagactaaaagacaatttgcagtgatgacacactgattaaaacaaagagtatccactttctctggtcttcagtgaggaactttgtaactgaagaagaaaattcatggttacaagttatttgtcactggatataaggaatttctaacaagcagagtcaataccctatcatgtattaaggaacgctgaatatttaagccagtaaataaagtataatgctggctgggtcttactgtggcaactgggaatatatgacaactattgctgtcctgagaaaacagtgacaattatttctagggaagaggagcataagggcacaaagattgctggtccttgaaaaaaatctcagcatctgtttgccatgagaaagttgtttgttgccattagcctttagggacagaatgagtaaacaacaaaagcataaaaataaggtgactggttatttcacctgagaacatcccagtggaggggaactacttccaccctacccgcaatgaacctagagaaaacaactttccttgcttgaaaagggtaacttaagcaccagggcaggtgcttatatatcagcgatggttccagtagaggcttcagttgacaagatggtcaatacgacatctgcacaacatgcagccagtattcgtttaaaatgtactcagtttcaggcactcggttgcatgatgcctatcagaaaaaacgagctaagggtagctataagaatacagctaaggtgaacttttgaagtgccaacactaataggcaccagattcctacagctaaggaactaaggcccttgagagcatccgaataagcaagctgctgaagacagttcctttttttttttttttttttttttttgaaacggagtcccgctcagtgccccaggctggatggagtgcagtggcccgatctctgctcactgcaagctctgcctcccgggttcacgccattctcctgcctcagcctcccgagtggctgggactacaggcgcccgccaccatgcccaactaattttttgtgtttttagtagagacggggtttcaccgcattagccaggatagtcttgatctcctgacctcgtgatctgcccgcctcagcctcccaaagtgctgggattacaggcgtgagctaccgcgcccggcccgaccgttccttttatgtaagtgataaagataaacagcgctattgaacaaataccagtcacctcaggagtgacctggccaggataacctcagattcaccagcagtaatgagtgaaaacaaagctccctaggtgtctctgccaaatggaaaataacattttgtggcagatagaaagtttggaaagaaatagttaactatgtctgaaggtacctgtaactttcaatagtggatcagttaccattgggcaagatgaaacattctcaaatggcaaaagaatgaagcacaagataaattcaacacaatgctcttgctttagtatattattatttctaacactcaaatgttggaaaggaagagcccaggagggtgagtcttctaatgataaaggtttgttgtgtttgtctattttgaaatcactgcacctgaaaagaaaacaataatagatggtgaaagtgagagaaagaggaatcttctccttactttatctccactaaggctaagagctctttatgggagctgtggttttgaaaggagacagagttgttgtgtcaaaggtggaagaggactagggtctgcaagtggagcatcaaactggagggaaagtggagaaccagcaaagtgtgaactcagcagcaggcttggtgatgaaagggtatatcgttttaccctcccaaagtgaacttaaagaatatttggaagttagaatctgatggcattcagactttgcaagcatggaccttctgattccaagggttatttatcattttctattcctaaatcttcttgctataattgtggctaaataagaggatatttacatcttataaaatgaaagcatcagaacattcttaaacatcataataataaaaatcatagcaataagcatgccttatagtggtgtcattcaaagcaaagtttcccctcaattagactcaaaattaattcattagcactgaatgtcagttctgcattagtgctcctttggtaatgattactcactgccaaggctccattaaatttccagttagaaatgatgaatgtgtacctctatttatcactgcttgtgattttatgagttatttttagaataataatatttttagcaatgtatctattgtttttccaacatttcttaatcaactaagccttggaaagtttatatatattaagctcacagtaggagtaaaatgtcatatatttttcagactctttgagacactggaataaataaactagcaaagtctctattacagagaactttataaaattatcatacacctcaatgtcaaaggaatttagaaatgtgaaaaaatagtttttattttcgttctgattatgattttattacaagttctttattctttagtctcctctctcttttaatattcttcctacattgaacctttagtgaagatattgccaacataggtatttagacatgttatatatttttagtttttatagattcttctatcaaatttccaatcttgggatggaatcaggtacacagactcacaactaataatcacaatatagttttctgagaagcactgatgtaaaatagaaaactcaggctgattcgctcaggtgtttgtgagaaagactgaataacattatacataaggtacctagtacagagccatacgaaaggattggaacttggttttgaaggatgcaatgatccactgaagaacattaagctaggagtgacatcatcaggtttgcatttttcaagggtaacgaacagttatgaagcaaatctgaggaaggtggaattgaggagtttaaagacaaaaggatgggtttagagaccatttcaatagcctggaaattacgagaaccaatttaaatcaatggcagtggaatgtggaatacaggggaaagatacaaggtatgcttaggagatagagtcgaaacatttagtaaatgactgagtttgaattgagaaaggttgtaggaaaagagaaatcaaggataacacactggttgttaacttggaagacttggtgcttgatgcttgggtgaattattatgctataaacagatgcaaaaagtttgaagaaacttagaggataggacaggtactagattaaaataatgagtttcattttgaatatgtgaagttttagtaaaattccataaaattaaattaagtaaaattttacttccataaaagtaaaattaagaggtccaagagatacacagatccagagaccagagagaggtctagagttagaggtatgagaatcataccataccatttattattttacgcccagaacaatcaaaaacatcttctgaatttctggttatagaagtataattagatttattgaagtaagccaacatggtggactatattatgaagccattaaaattgttttttaatgatgggacaatgctcaaaagataatattaaatcaaatttaaaaatgcaaaattttgtacaataaaatttctattatttaaataaaatgggccttaaaaagatggaaggaaaataattaaacagttataatgctcacattagggttaagagtttatggtaatttttcttttttttctatgaatcaatattttacaagttttctatgtgcatttcttaaaagtcattttagggtaaggataggctcttggaaagatattgattaaactgagtctaaagaactgatagagttgagtcagatgaagagagcggtgttagcagaggtacaaaggtgaggaatatagtgtgtacttgaaactataagcagttaagagttggtgaagtatagaatgatggcagagagtcatcagagaggaagctgaatagggagagatggtcacactgtgggggtttgctacattaaaattatatcctatgtgctctgggaaactcttgaagaaatatacataatgcatgtattcatttgctaggactgccataacaaagtgccacagacttgttggactaaacaatagaaatttatcttcttatagttctggaggccagaagtccaatatcaaggtgtcagcaaggttggtttcttctgaaggcgctctccttggcttgtgaatggccatcttctccccatgtctttacatgatttctctctctatctatctatctatctatatatgtatgtatatatgtacatatgtacatatatatatatatatcttaatctcctgtttgtataaagatatcactcatattggattacggtccaccctagtgacctcattttaacttaaatgctgctttaaataccttatcttcaatatagtcttattctgtggcaccaggaattgaaatttcaacctatgaattttgagggaacacaactcagcccacaacggggagtgatgtggttaaatttcatttggtaatcatgtggagttttgagaaagaagagataaatcaataggttattgtaataatcatggaatcatggcaaaactcggattattctatagaactttgttaacagagatggagagaaagggacaaattactgaaatatttaggaaataaaattggcacaggattaaggttacttggatgttagaaatgagagggagaagcctaatctaggtctctggatttctgatgtgaatgacccagtagatggtgacatcatcaatgaaggttaaaaaaaaatccaaagtaagaagcttgttcagagaggaaatgatgaattcagtttgaggaatccaattacattacctgaaatacagttagatagaggactctgaagcacaaagacagataattgggctggaagtctagattttgtctttactattctcatatgttatgtgaaactatgagagcccatcctcacataccgagtgataagaacaatatacttaaaagaaaagaaaaccaacatttatgggacaggcagagaacaagcccctgaaagagacagtaaagtatgaggtgaagcaggaaaggcacttatcatagagtccaagagagtagagagctttgatatagggaataatcaatagagatcccaaaggtaaagattgataaatgttagctggatttgaaatcagaaggatttttggacatttatacctaataacaattccttaggctttcatgtgctagccaatggataaagcatggcatgtgtatgatatttcattttgagattcattataatagatcaaggaaactgtcactatgtccattttacagattgcaaagattatatctcaagacagtcaaatatcttgcctaagttcagcctgagaacagcaaatgtgggagtcagttctagctttcatcttacgttaccaaagcaggtgtgataagtggatgggctctaaattcagagagcagtggggcaatgaatgaatggttggtgaggaagtaagatagactgcccttttcagcaggggagaaggtttagtacattgcctacacacagtagatgctcaataaactttagttcagtgaacaagaaataaatgtcaacgtgtgctagctatcaggtttacaggttaggtgtggaagaggaggtagcagaggtgtcgagtacacacagcccaaggttaaggagccagtagagagaataatgccaaagaagaaaagggaaaatttagcaaaccaggtccttcatagaagaggttgattgagcctggtatcaagtatagaagcaagaattttacctgagtagatggactccttctttgagattgaattaaaaaacagtgaggtatagaaataggtgtatagggacaaaaggcaaattgtttcatctcccaacaatcccctccatattaagctcccttatgaaaaaaatatctcaccattcctaataagttatttcctttaaagttttaataaatgtatacatgcaattcccgatgcctagaattccttctctttttttgtatagtaaacgcttatggagaaataaagacccaaattataagttagctcttaaaattatttcttgaattctcccaacattctatcactccctccattttccacctcttagagcactcactccctcttctgtagaggcttggaagccatagataattatgcttccattttttattaagccttttgaaacactttaacatatcaacaaaatatttgaaaatgttataaggtatgtcttagagcaagcatgacgtagcttgaacacaattgcatgtatttagctcaaacttttatatgccaacaattatatgatgtaaattttcttaatggttagctaaagactgctctagctgatgactgcattttgtaataaaaatatattcttaattcattgacttttaataatgttataccacaaatgatgcataaattgggaaagtttatacaatgtattttaagaataaaatgttgcttgccattataaagatttatgtattgatcaccttgatgtttaaagaaaatgatgtatacgtatgccctatcttcaaagccaaattgtatgctgtaataccttaagctttcagctggtgttaaattttggctggttcaatagtgggctgagactattgattgctatattactgttctgttagacaattttatttttgaataatctatatgccctatgagaagatcaaatgatatggcagagagatctgagacaaaacactaagattcaattgttttaagttcagcaggattaagttgcacgtttcagaatcattcaaaaatgcaccgaatgcataattatattcagtttgtgtttgaatttgagctatgtagcatgatccatgtgtaatttataaaatatagtcgagtatttaaaatataaaaatataatattctttgtaatattttacacatgctgttattttccttatatcagcaaaataagaatgtgaactttataaacatacattgagagagttaagataatcatgtgaaatggctatatcaatctgtaaacacctcttttaaatgactatttcatattccatccaaaaataaacacataaaacccaacttatagcaaaatccatgagacaaaatattctcacaaggaatctgtttatgtattgcctgtcaattaaacatgaagctaagtaatttttgttcaaataatctatgtatgttcccagtgtacctattatatacatgaaattgttcaacctttagagtatttgccaaatttttctaatgtaagtaataattatatggattttagaactacacttcttacattctattgtgaaaatattttaagattcatgtgcactaatttcagttgtatgcaaaaatactgtaatgaaacattatattttcattttttaatggaaaatatacaagtctctttagatggatcaaaaagaaatttctaatgcagctaatgtgttcaaccatcctttaatattctgtgtagccataattgcatttgtctgagcatatccaacgtttaaattagtacaagttggtaaagttgtagcatttaattagtttgaataaatgtagtacataaaaaattgtaaacaaaatatgtgtaagttattaattgaaatgtgattggtggcttttctggaagaaatggggagaaacttaaagtagagtaatagcatgattaatttattcaggatggtttctgctgaaaaattatgttcaataagaatctgtcatgacttatgatcatttgttactctacagtatatcaaatataatggagtcaggtgcacaagctgtaaaagcaactgttataaaaatgccaatttcttaaattaaaaaggtggttacttaaatgatttaattccaaatacccatactttattaatttgagctattgctgtatctagagatgataaatatttttataaatgattttgttctcatatatacatttatcattctgcattcaagtcaatggtttttaaaatttcctctcaagatccaaattacacatattttcattaaaacatggagatgcctggcaaaagttgctatttaaatatttaacagaaaaataaatgggaagaataattatttgtttacaacccaaaacattatttcagtcaaaattcttttaatgtaataaaatgtgttcttctacagtttgttcatttacatatacctctctcattggtgtctttcaatgatgttttctcatatgagatctttttcaaacactatggagattaaactgaattatcttaatatgatttgagctgctatactggagaagaaaatttcatagaagggaaattcataaattttgtcattttcagagagtgtaggggacattaaaattcatagtaaaatatcaatgtgtccatttctattatgccttaaacagtatgcgttaatcatgcttgttatctcagagagttattggaaatgagtagaagcttggaagtgatagtgtaagcaagtaattttcatgacaatggcttatcacctgatgatcatcatatgaaagttttgcttgctcctttcagggggtgtgcatgtttttcgtcatctggcccaattccactctgagtttaattttctgtttttattttatctaacattttttcctaatcctagaactatgcctctttacaaaaatattacttaaaacctatttctacagaattacattaaaacaagtaaactttctacctccctgtactgtaaaccaattggtaattattttagtcaccttctgcattaggagttccatcttttgggcattgaaattgatttttttcatcttagcatctgaagatccagagtgtgccccttgcccaatcgcctgagactatacagtgacacctacaacagaggatgtggagggagcagcttttcgggcaccagaaatggcagcatcaggagcatcagcacgaatagactttgtagaggtagttctcccaaactatattatgaaaccaaacatttttggtgcgctacctgctgatgggggctgccttcttactgcctagtatctacaaaatgtttggtctttgttaaagtttaacgatgacatttctgactaatatagagagacctgatttttttccaaatgtgttcagttgccataactttcaatgaatatgaaattttatcagtctcagaaaaacattaatacccatatttttatctaattgatttcactatttgttatgttaaggtgcttttgtgtataatttttgtatatatttttaaatgggatcaaactaagccataatttaaaagtcatcctaatgcagtaaataagataatttctctagtttgttaaattcttcagagaccgaatataattgctcgtttttctgtcatactccctgatgatgttccattgtggacttattttgcaaagttcccagatggcacaagtcaaaatatgaaatgctgatgattgattgattttatgtatcctttcatcttatgtaatttaatgtggaacagttattttgtagctctaaaatacatttgttaattaaccatattggcttttcatgcagttcaatggcttatagcatttcaatttgcatagaaaatgaatctctgtaatgatacttttgctaaataaataacaatcgacataatgggttcatttgcttttaacattttatacatacaatttagaagtaggatatatttcatattgaaattttgaaaagcttgaaattcaacatacaaggtcaccatcttgctgatgcctaatgcagtacagcaaattcattcttcatcccatgttaactcctttttggaacaagtcaaaatacaaataatttacaatgattgtgttggagctattgcttgattaaatacaattcaaaggttctttttataaaacaggtgtgagcaggacacattgcacttacgggcttttcctatttttttggttctatttcattttactgcctaggaaagaaacatttttttgtaaaacctatgctatggaactgaaatgtactttattgaatatttctattctgttttatgaatatcaattatgtgaaatatataaatataaaattgccttagaatgcctaactctttgtataaaacagatatctgaaagtagatgttggttttttgttcaaattgtgtaaatgctgatttttccatgagtacttatgaagatctatatgtaaaaattttaagtctgcttactgtgtttgtaccaccttgttcttagctgtgtatactctatgctaattgacttctgtcattgtcacatatattgcatatgtctctcaaaaattaaaaggtatattgctattctaaaaataaaaaatgtaaattcctgacattgctgtagaataagttgcactatcttagtgtagttttataatgtgttcttatgaattctcagtgcccttcaaatgccaccaatttattcagctttccgaaatttattttagagattacttaaaaagagattgcttaaaacattctatgtgaaagtagctttaaagattaaagaaacattgctgttttgactttatgatgttctaaggaagaaactggacctttcattattaaagcttaaaaatcttatacagcagcaataaaagtctgcatcagtgtgcagactgttgaataattaaccttactgcagtaaaccatgttgcctttctggtctcgataatatataacaattgaaaacttgtatgtgtagcataaaggaaacttttcttaatgaaaagaaattaacaagtaagtggaataactgttatcaaagctaaagttctttaaaacttaatcagcagaagtgattataaaagtaaaaggttaaaataaatacaattgaatataatatatgatttattttgcccactgtccatgttatatgtcctggttagtgcttcaacaatcataagtgattgtaaattcattcataatatttgtgtgactctaatcttttattctaagaggaattatgcataccagtttaacaaaatactgcctgtgtttatctgtgacgtttcatatattttcagcctcaatatatactttttaaaaaaaacaggtaaaatgataataagatgaaatatttttatatgcatctatattgaaataattgtattgaactgtcttttataaatatattctattgattttacattcatgagtagtaggatatgcatattaagccaaaatttggctaaacatattcagtaaagaaaaacaacaacaaaaacgaccccttaagaagaaggcagtacagtatgtggctacccattctgtacgatacaaataccatacaaccctttccttcttcataatattagactactctcaggaacgtggggcatgatgtgaacaacactctgtattgcctttcatcattttattggcatctcatgaagagaagccagttgttatgccttttaggagtgcctcagagaatagaatacatatgcccgtatatttctcagaagttacgggtttctggaactttgttaagaatttcataactgtattctaccagccatattttttgtccatatcaaattttgccaattaaggttcctgctattttgtcttatctttttaatcaaatcaacttttcttgagccaaaactggcagatctaaattttgtcaccaaaaattatgattattttatcagtttttaaagggaaggcatgttaggcatagtcagttttatttgtgtcacttgtttctgccactagcaatcaatataagttaataaagactgatagtctatatttattcattggcataaaaaatactattaccagggcaaaaatatagcatctggaggtctagtagagtaaaaataataattccagaacagatgggtttagaacagcatgagaatgtggaaactacgtcttgctcaaatctcaatgaggtaaaaatcttttattaaaccagtaattcttccaaccctcacacacgtacaacttgctttgatttcagctgtattttacatatagatagaacatctgaaatccaagctcttcatcgcctcttgtgcttgggcaaattttagagaaatgcaaatctttaattcaatccaattcaataaacatttgttgaggactgactgtgtgtcaagcacaaggattaacactagaaacaccatgtacaaggagtccctgctgtttagaagcttaaggtctgataaggaacagagacaagtgaagcattatattcagtacagcatagtatataagattatggagatgtgatgaagtcccagaaagagtacagagaagttatatttcttagtcctatctgtaaagtccaggtgaagcctgaggagtctttcaaaccataaattggaattttaaaatgggcaaaaggaaaatgagtgttactcatagagaaaaccccatgttacaaggggttgatatgtaaaatagaaagcacgaggaaggagtaaccatgaggtagacagagaagaaactgtgaaggggctctcatgacatggttagactttattttctgggcaatagagaggttttgatgaaatggttttaagcagcggaatgacacgttagatttgtaagtgatgggataacattggctaagtaagaattcaaactccttgctaagcaagcaaataacaaaagccactctgggccaagtgtagtggtgtacacctataatcccattgctttgagaggccaaggcaggaggatcacttgaggccaagagtttgaggctacaatgagctatgatcacaccactgcactccagcctgggcaacagaacaagaccctgtctctaaagctacttagacaattctttttttaaaaaaaaccagttttattgaggtgtgtgaaatacataccatagaatgaactcattttaagtgtacaattcaatatttttaatacatttatagagaagtgcaattatcaccacaatttaattttggccatttctattatccaagtgcccaagttcttcctgcttattcacagttaatccccattctaatctcctttcctaccctagccccaggtaactactaaactgctttctgtctttatacattgtccttttctgaacatttcatataagtagaattattcatgtagacatcttttatgtctggttcctttcacttagcataacacttagcataacccataataatctggcataacctgtagtgaggtttctgccagattattattagacaaacagaatagacatattttactcctaaagagactatgaacactgggaaaacaacacgtgtgataaggatgtggtgtgagactatcaaaggtgtagaggagacaagaaattgagggaccaagataggacaggatggcagggaaaaagagtcagctggagtagaagaatcagaagtgcagttatgtgaaagtagaagaaaacaagtcaagatattttaataaaatttgctgaagactaaagatttgaactgtattgccttcctaccttaaagatttaaaacaggtatttgtaaagattggacttcctgtttgtcgttactactagattctagatactacaggtatcacaagcttcattagtttcttggagaagtaaagtcacttctccaaagaatccttatcttagaaaaaaaaaaaaaaacaagaatgctcttaaatagtgacagactgacatctgcatttaaaacataaaggggcaaaagtgcatctagaacaagctgtattatctttgaaaatccactgtggagccaatgggacattttgatagtcacactgagattggagatacagtgtttttagagaatgcacgactgatttaagaatgcttgttcagatgaagaaacagacttaggtggcatgatgaggtcattcaagtcgtaaaaatttaaaaattctttctgcaggagaagacaaggcttctggcagattttctgagtctatattcaagatccaccccactaactgagaatggctgccttgctgatttgactgttactgtagaactgaagataaagcgaattttggagttgtttgtgtgatctactagttactagaaaaatcacaggtttataatgcagctaatgggataaacagactttgattttagggcagtgaagactctctgcatgatggataatgatactatatatataaataaatgtatatatatataaaagaacaagctgtgtgtgatatatatttactctgctatgtataatatttatatataaatatatattataaaatgtatatatacatatatttatatatatggtgtacatttgtccaaatccgtcaaatatatattataatccatccatgatggatacatgtcattatacatttgtccaaacccatcaaatgtacactgagagtgaaccctaatgtaaactgtggactttgggtgactataatgtgtagatgtagtttatcagttgaaacaatgtaccactcaggccgggaatgtgaatattagggaaagctatgcatgtgttcgggtggggagtatatgagaaatctctgtgctttcctctcaattttgctgtaaacctaaaactgctttaaaaaaaaaaaaaaaaaaaaaaaagactgcgcactggccagaatatgcctgccacttagttgttacgaggaagggacaaactcaaaaacaaagaacccactaagtaggaaatctgacaaaaatttccaggcctaatgtcatgactggcctcaggccaagaactctctgatgaatgaaattggagtctcagaagacagcagcaaagacggtttctgagaggctactgaaaggaccctctctcgagaaaccacatctccaaacccctaggagtgggaagtggtcctgccaagcacggttcctagaggggcccaggggtccgctgtggcctcggtaggaatgagagatttctcagcgctggttggaaatactgcagaacatccaggcggggtggcacatgcctgtagtcccagctactcaggagactgaggcaggaggatttcttgaccccaggagttctaggctgtagtgtattatgctgatcgggtggcaacactaagtttggcatcaatatggtgaccttcctggagcggggaccactcggttttctaaggaggggtgaaccaactcaggtcggaaacggagcaggtcaaaatttccatactgaacagaaattctcaggaacaatcccaggttaaggactgcagattcattccctaagccatggagtcagggtcccctgccttggtcagggtgaacgggacaaacccggaaccctgaaggttggtcttgtttgctgctgttaaagtaacaaggagctattttaccacccataaaactaagactctattccttagaagagaggaggttaactactaatacgaatgtgttttaattacaggaagttggtatttctccgggaaatgctccgagacactggagaaatgtttgcatacgctgggtaggggagaaaaagaggcaaattaaaatgggatgggataaaatggagatttttatatttttccttcctcctttcccacttagctttgttctctgtgtccacttcctgagagaagaaaagacaacagtcactgcaagatgctctcaaataaaagtcaaaggaggagaattattctctctcgtgggctccttgtgggagctggaggtgagaggacatcaggagcttgcactgtaggacttcagcgctgagcaaggggatgatcagggcagaagatggggtagacgtgatgtcaggaaagagacttctttgggtaggagagtaaggttttcctaggagttttggtgtgctatgcagtcggatagaaaataccagtaagaagtgctgtgagccaacttcttagatcctcttaaatgttgacaataacctcaggacagaaattgccatttgggggtctatgtttctctaagtagcctttatgaaaatatcatgggagtgaatacgaaggacagggagaccagctgctgtaatcatgacaaaagaaggagagtattattgataatagggaagaaaaagtaaacaaaattgggagacatttttggaagtgaaattcaaaggactttcatcagagtgtagcttattcttgtcatatataaggaaaaaaagaagaagttttacaaaaactgcttctaggttgttccttaaatcagggctttactctgtggctttgtggtttaatttcaaaagtattttccagaaaaaaaagacacagccatgttcaaagcaactagcaacaaattgcaaagccagaataatgcatcttgcatttataactgtttttgattgacttataaatctgcttccctttattagtttgactaagatccagtccaaatgtcaatgcctctttgaagatttccctggatccccaaacatgtgcacatgggactttggatataaaatttctaaaatgttatcacatcatattttaattagttgtttcaaggtctgctttcttgagctctttgaaagcgggactatgtcttattcatcattatagctccactggatagaaaagtgctttgtgcaaagttagatttgttaaatgaatagaggggatatggcaatcagaggaaatgcaatcttctgctgagtgtcagaagtactattatatgcaataacaacaaaattaaaatgtctaaaatcagtccctgtatctataaaaatatgaaactatttccaatattattcctatcaaaatttccaatgaaaccagtacttgtatgtgctattagttctaatcatgctgctagaacattgttgagtttgaaattgttagcatcattcaactaatatgcgtatagctgtcacttccgtttgaattattatgacaccaaaagctcaggcaacaaaagaaaaacaaatgagactaactcaaacaaaaaggtttttacacagcaaatgaaacagtcaacaaaataaaaaggcaggctgggtatggtgactcgcacctataatctcagaactttaggaggccaaggcaggaggatcactgaggccagagttcaagactagtctgggcaacatagtaagatccccatctctacaaaaaaaaaaacaaaattaaccaagagtggtagtgcatgcttgtggtctcagctacttgggaggctgaggtgggaggatcactgaaaccgaggagaacaagactgcagtgagccatgactgcaccactgcactccagcctgggtgacagagtgagaccctgtctccagattaaaaaaaaaaaaaaaagaacaaatacaaggcaccctatagatggggagaaaatatttgcaaactatatatctaataagaagttaatatccaaaatatattttaagagttcatacgactgaatagcaaaaaaaaaaaaaaagcaaacaaaaaataacccagtttacaaaatggaatcgacaaaggatgtaaataaacatttttccaaagaagacttatgaatgacaacaagtatatgagaagatgttcaacatcactaatcatcaggaaaatgcaaatcaaagccatgagttatcacagtataccagttaggatgggtattatcaagaagactagagataactagatattggaaagagagtagagaaaaggtaaactgctgagaatgtaaattggtacagccattacagaaaacggtacgaagattccttaaaaagttaaaactaccatatgatccagcaattccccttctgtatatattataaccaaagaaaataaaaaaatcaaagagagatttgcagtcccatgttcattgcaggattattcacaatagccaaaatatggaaacaacgtaaatgcctattgactgatgaatggataaagaaattgcattatatatgtacatacctacacacacaaatataaacactatataaatatcatttagccttaaaaacagagattctaccatttgtaacaacatggatgaaactagaggacatttttctttttttttttttttaattatactttatgttttagggtacatgtgcacattgtgcaggttagttacatatgtatacatgtgccatgctggtgtgctgcacccactaacccgtcatctagcattaggtatatctcccaatgctatccctcccccgccccccaccccaccacagtatccagagtgtgatattccccttcctgtgtccatgtgatctcattgctcaattcccacctatgagtgagaatatgcggtgtttggttttttgttcttgcgatagtttactgagaatgatgatttccaatttcatccatgtccctacaaaggacatgaacttatcattttttatggctgcatagtattccatggtgtatatgtgccacattttcttaatccagtttatcattgttggacatttgggttggttccaagtctttgctattgtgaataatgccacaataaacatacgtgtgcatgtgtctttatagcagcatgatttatattcctttgggtatatacccagtaatgggatggctgggtcaaatggtatttctaattctagatccctgaggaatcaccacactgacttccacaatggttgaactagtttacagtcccaccaacagtgtaaaagtgttcctatttctccacatcctctccagcacctgttgtttcctgactttttaatgattgccattctacctggtgtgagatggtatctcattgtggttttgatttgcatttctctgatggccaatgatgatgagcattttttcatgtgttttttggctgcataaatgtcttcttttgagaagtgtctgttcatgtccttcacccactttttgatggggttgtttgtttttttcttgtaaatttgtttgagttcattgtagattctggatattagctctttgtcagatgagtaggttgtgaaaattttctcccattttgtaggttgcctgttcactctgatggtagtttgttttgctgtgcaaaagctctttagtttaattagatcccatttgtcaattttgtcttttgttgccattgcttttggtgttttagacatgaagtccttgcccatgcctatgtccggaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatgtattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgccttggcgatgtgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcttcttttatttcattgagcagtggtttgtagttctccttgaagaggtccttcacatcccttgtaagttggattcctaggtattttattctctttgaagcaattgtgaatgggagttcactcatgatttggctctctgtttgtatgttgttggtgtataagaatgcttgtgatttttgtacattgattttgtatcctgagactttgctgaagttgcttatcaccttaaggcgattttgggctgagacaatggggttttctagatatacaatcatgtcgtctgcaaacagggacaatttgacttcctcttttcctaattgaatagcctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcataggtagctcttattattttgaaatacgtcccatcaatacctaatttattgagaatttttagcatgaagggtttttgaattttgtcaaaggctttttctgcatctattgagataatcatgtggtttttgtctttggctctgtttatatgctggattacatttattgatttgtgtatattgaaccagccttgcatcacagggatgaagcccacttgatcatggtgggtaagctttttgatgtgctgctggattcggtttgccagtattttattgaggatttttgcatcaatgttcatcaaggatattggtctaaaattctcttttttggttgtgtctctgcccggctttggtatcagaatgatgccggcctcataaaatgagttagggaggattccctctttttctattgattggaatagtttcagaaggaatggtaccagttcctccttgtacctctggtagaattcagctgtgaatccatctggtcctggactctttttggttggtaaactattgattattgccacaatttcagctcctgttattggtctattcagagattcaacttcttcctggtttagtcttgggagagtgtatgtttcgaggaatttatccatttcttctagattttctagtttatttgcgtagaggtgtttgtagtattctctgatggtagtttgtatttctgtgggatcggtggtgatatcccctttatcattttttactgtgtctatttgattcttctctctttttttctttattagtcttgctagcagtctatcagttttgttgatccttgcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatgttgtgtctttgttctcgttagtttcaaagaacatctttatttctgccttcatttcgttatgtatccagtagtcattcaggagcagtttgttcagtttccatgtagttgagcagttttgagtgagtttgttagtcctgagttctagtttgattgcactgtggtctgagagacagtttgttataatctctgttcttttacatttgctgaggagtgctttacttccaagtatgtggtcaattttggaataggtgtggtgtggtgctgaaaaaaatgtatattctgttgatttggggtggagagttctgtagatgtctattaggtccggttggtgcagagctgagttcaattcctgggtatccttgttaactttctgtctcgtttatctgtctaatgttgacagtggggtattaaagtctcccattgttaatgtgtgggagtctaagtctctttgtaggtcactcaggacttgctttacgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaagccctgccttttttggttttccatttgtttggtagatcttcctccatccttttattttgagcttatgtgtgtctctgcacgtgagatgggtttcctgaatacagcacactgatgggtcttgactctttatccaatttgccagtctgtgtcttttaattggagcatttagcccatttacatttaaagttaatattgttatgtgtgaatttgatcctgtcattatgatgttagctggtgattttgctcattagttgatgcagtttcttcctagtctcgatggtctttacattttggcatgattttgcagcgactggtactggttgttcctttccatgtttagcgcttccttcaggagctcttttagggcaggcctggtggtgacaaaatctctcagcatttgcttgtctgtaaagtattttatttctccttcacttatgaagcttagtttggctggatatgaaattctgggtcgaaaattcttttctttaagaatgttgaaaattggcccccactcccttgtggcttgtagggtttctgccgagagatccgctgttagtctgatgggcttccctttgtgggtaacccgacctttctctctggctgcccttaacattttttcctacatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccccatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcattggctcctgaggcttctgcattcttcacgtagttctcgagccttggttttcagctccatcagctcctttaagcacttctctctattggttattctagttatacattcgtctaaatttttttcaaagttttcaacttctttgcctttggtttgaatgtcctcccatagctcagagtaatttgatcgtctgaagccttcttctctcagctcgccaaagtcattctctgtccagctttgttccgttgctggtgaggaactgcgttcctttggaggaggagaggcactctgtgttttagagtttccagtttttctgttctgttttttccccatctttgtggttttatctacttttggtctttgatgatggtgatgtacagatgggtttttggtgtggatgtcctttctgtttgttagttttccttctaacagacaggaccctcagctgcaggtctgttggaataccctgctgtgtgaggtgtcagtgtgcccctgctggggggtgcctctcagttaggctgctcaggggtcaggggtcagggacccacttgaggaggcagtctgcccgttctcagatctccagctgcgtgttgggagaaccactgctcccttcaaagctgtcagacagggacatttaagtctgcagaggttactgctgtctttttgtttgtctgtgccctgtctccagaggtggcgcctacagaggcaggcaggcctccttgagctgtggtgggctccacccagtttgagcttcctggctgctttgtttacctaagcaagcctgggcaatggcggtcgcccctcccccagcctcactgcctccttgcagtttgatctcagactgctgtgctagcaatcagcgagactctgtgggcgtaggaccctcggatccaggtgcgggatataatctcatggtgcgccgttttttaagccagtctgaaaagcgcaatattcgggtgggagtgacccgattttccaggtgcgtccgtcacccctttctttgacttggaaagggaactccccgacccttgcacttcccaagtgaggcaatgcctcgccctgctttggctcgcgcacggtgcgcgcacccactgacctgcacccactgtctggcactccctagtgagatgaacccggtacctcagatggaaatgcagaaatcacccgtcttctgcgtcgctcacgctgggagctgtataccggagctgttcctattcggccatcttggctcctcctcctgaggacatttttctaagtgaaataagccaaacacagaaagaaaaatactacatgatctcatttataggtggaatctaaaaaaaaaacagacagaagccgagagtagaacagtggttaccagctgtttgggggtagggaagatggggagatgtagcccaaaggagacaaacttgcagttgtaaaatggatacacactggagacctaatgtacagcataagaatatattgagtacttgaaatatgctaagagagtggatcttaagtacagtcatacctcagagatattgcagactcagtttcacaccaccacaataaagcaaatattgcaatgaaactattgttttccactgcatataaacattatgtttacaatatactgtagtctattaagtgtacaatagcattatgtctttaaaaacaatatacatatcctaatgaaaaaatactttattgctaaaaattctaacaatcttctgatgcttcagcaagtagtaatatttttgttgatagagggtctttccttgatgttagtgactgctgactgatcagggtggtggttgattaaggttatggtggctccggcaatttcttaaaataagacaacaatgaagtttgctgcattgattgactcttcctttcatgaaagatttctctagaacatctttctctttaagatgctaagatttctctgtagcatgtgatgctatttgatagcattttacctacagtagaacttctttcaaaatttgagtctatcctctcaaacatttgtggctactttattaataagtttatgtaatattctgaattctttcttgtcatttcaacaatgttcacagcatctttaccaggagtagattccatctcaagaaaccactttcgctaggtgcagtgactcactcctgtaatcccagcactatgggaggctaaagcaggtggattacttcagcccagaagttcgctatcaacctgggcaacacgccaaagctctgtctctacaaaaatatacaaaattagctaggtgtggtgtcatgcacctgtagtcccagctactcaggaggctgaggtgggaggatcacttgagcctggctggttaaggcttcagtgagtcaagactgtgccactcactccagcctggaagacagagtgagaccctgtctaaaagtagagtaaggagatagagaagaagaaggagaggaggaggaggaggaggaggaggaaagaaatcactttcttagatcatccataagaagcaatttcctgtctgttaaagttttatgagattgcagcaattcagtcacatcttcaggctccacttctaattttagatctctttctaccacattgaaattactttctacactgaagtcttaaacccctcaaagtcatccatgagggttggaatcaatttcttccaaacttatgttaatgttgatagtttgatctcctctcataaattatgattgctgttaatggcatctagaatggtgaatcctctccagaatgttttcaatttactttgcccaggtccatgtgaggaatcactatctggctctacaaaatgtatttcttaaataataaggcttgaaagtcaaaattactccttgacccattaacagcagaatggatgttgtattcacaggcataaaaacaacactaatcttgtaaatctccttgggagcttttgggtgactaggtgcattgtcaatgaacagtatattttgaaaggaatctttgtttctgagcagtaggtctcaacagtagtcttaaaatattcagcaaaccatgtaaacagaggtgttgtcatccagactttgttgttccatttctaaagcacatgcagaatagatttagcataattcttaaggctcctaagattttcagaatggtaaatgagcattggctttaactttaatttaccagtggcattagcctctaataagcgagtcagactgtcctttgaagctttgatggcaggcattgatatttcctctttagctttgaatgtcccagatggcattttcttccaaaggaaggctattttatctatattgaaaacctgttttttattgtagccaccttcattaattatctgagctagatcttctggataattcactgcagcttctacatcagcacttgtcgcttcaccttgcacttttatgtcatgaagatgacttatttccttaaacttcacaaaccaacctctgctagcttcaaacttttcttcttcagcttccttacttttctcagtcttcatagtattgaagagagttagggtcttgctctggattagtctttggcttaagagaatgttgtggctggtttgatcttctgtccagaccactaccactttctccacattagcagtaagcctgtttcactttcttatcattcatgtattcactgaagtggcacttttgatttccttcaagaaatgttcctttgaatttacaacttggctaactgtttggcacaagaggtatagcttttggttgactccagcttctgacatgccttcctcactaagcttaaccatttctagcttttgatttaaagtggaagacccacaaatcttcctttcacttgaacacttagagaccattatagggttattgattggcctaatttgttgtgtctcagggaatagagatcccaaggagagggagagaggaatggtcttttggtggaacaggcagaatatacacagcatttatcaaattaacttttccatcttatatgggcatggttcatggctccccaaaacaattacaatagtagtaacatcaaatatcactgatcattggctgggcatggtggctcacacctgtaatccaagcactttgggaggccagggtgggtggatcacttgaggcctggagttcaagaccagcctagccaacatggtgaaaccccacctctactaaaaatacaaaacttagccaggtgtggtggtgtacatctgtagtgccagctactcaggaggctgaggcaggagaattgtttgaacccaggaggtggaagttgcagtgagccgagatcatgacactgaactccagcctgggcaacagagtaagactttgtctcaaaaacgaaaaaaaaatcactgattataaataaacataatagataaaacaataaaggaaaagtttaatattaccaaaagtgatacaaagacatgagtgagcacatgctgttggaaaaatggtgccaatagacttgctcaacacagggttgccacaaaccttcaatgtgtaaaaaatgaaatacctgtgaagcacaataaagtaaagtgcaataaaatgacacgtgcctgtattctcatcacaaaaaaagaaaaaaaaagtgaagtgatgggtatctttattcacttgattgtggtaataatttcacaatgtatacatatattgaaacatcagtctgtatattgaatatatactacttgtttatgtcaattataactcaataaaactgaataaattgaaaactccaaagtatcgtaaaaggggagcagttatatttcaactattggaaagacggcagcagcatatcaggcagagaaaatagtggatgtaggaaagtctgacatatatttagtgaatgaggagtggcctggttttctgatcagggaagtaagttaaaaacagtggtagaaataaaagtggaaaggtagggtgaggagtttggacctcactaagtggtaactcttaaagattacctatgtgagtagcaaggacacagttggtactcaaggcatgagttaaaaactcaaatgagaaaaaaatgttggagcaacaccacgcagataaatccaatgatgtatttaaatatgatacaatacaatacacatctttaaaattccttctggtactgtaattgacctgaagatacatgaaatcgtatgaattacgactcaaactgtcatccctctaacaaaacagtaagccagacaaaactgatttagcctataagttgtcccttattccataataatgagaggtagatactatttatttactggacatgccaagctctttacctacatgtattatttcactgacccttgtaacaactgagtgaggtatgtgttgtcatcctgttacacatgagaaaattgagtctcagagaaattaaacaattatttactcaagaacactttgatagaaagtggcagaaaccagattcaaaccccttctctccagtactccatcttgtatcaacttgactgttttgcctacagagtatagttttgcttgaattctgtttaagaaatcaaattacttatgctagtgttgcttatttgatttacctccaaggcacttgattaagaatcaaattatattaatgtttcttgtgaatgacagatattcatcacatgttacaagaattgcttattctcttgaggtgtttttcatttttaaaaacacatccaggtacattttgggttcttgaatcacagattaaccattcagtcctcacaatgggagattgaagaaataatcaatgggtttcatatggttaaaagagtatcagtttctttgcaataatgtaatactgtccttaatttacaactcaatgtctttagctatcaattttatttttccaaccttttaaaatcaaggtggtttcttttgcatttcctaagattcaagattgaaaatgtaacaaaatctcagacagctaacatgtattaaacttttcaaagcacatgaaacaatgctttcaaaaatatgttttttgaactacgcattaacctcgtaagaggagcataaaaatatttcccattcaactaataagaactttaatgtcatttggtatggataatacactaatttttgtttcagcttatgctatgtattgaaatacattctatatttttttcttgaaaaagtgtttggaattgtaatttttattataagtagaaactttgtagaagaattttatacaaactggtaaaactttgaaatgtaaattatttcctacaataattaccataaatatgggtaaatagctcagaatgtttctatatgtaaccactgagtaatgtactttcagtattccttgatataagttatgggaaccatgtagcttctaataatatcaaggcatatgctattttaagagattttttaatttaatttttaatacaaaatttctcatacttgaaaaccaaacttttttttttagtcctctcaatgagctcttggttttgaggaagagatattctaggccaaagaaagtcatgtgcaaaagcggggagatgaatgagaaactgatgaactgtgcaggatgcaaggagattcattggtgtgggaggcatcggctactgaatgtcaagacatgaggtttgagcaatagagcagagcctattcaagagtggttttatattccagtataacggttagatcaacaaagagaaataaacctcattgcattgatttttcaagaaatagtgatcattttattttacctaatctagggaccagaatctaataggtaatatagttgctaatatttattgagctctaaattctttacatgtattaattcacatagccctcatagtatcttgaagtaggtattattattttccccattttacaaataaagaaactaaaacacaaagaagcaacttgcccaaggtcaggaagctggtaaggtgtgggggaaggatttgaaccctggcagtgtgactctcgccttgttcttaattactatgcacagctgaatagagaccacccaaaatgaattcaagatatgagaatatgtgatgattttgttggaggtttgaatacatattgaattcatttcctcacatttgttagtaaaatatcctagcctcctttttgtttttgaaaacagttttattgaagtacaattgccatctaataaactgacatacttaacatgtacaaattcacaatattcaagaaagaaaagcaacctaaatgtctatggacagatgaataaaaaatgtggcatttgtacacattacacacaatgaaatattaatcagcctttaaaaagacaaaaatgctaccatttttaaaaacatggatggacctggaagacattatgttaactaaaataagtcagttgtaggacaaatgctgtgtaatatctctaatatgaggcacctaaaataatcaaaggtatagaagtaaatagtagaatgatggttaccagaagatgtcaggggtataaagttacagttatacaatatgagtaagttccagagatcttctgtacaacaaacagtggccgttatcaacaataaggtattgtgtacataaaaatttaggccggggggcgtggctcacacctgtaatcccagcactttgggaggccaaggcaggcggatcacccgaggtcgggagttcaagaccagcctgaccaacacctctgctaaaatacaacatctctactaaaaacacaaaattagccaggcgtggtggtgcttgcctgtaatcccagctactcgggaggctgaggcaggtgaatcgcttgaacccaggtggcagaggttgcagtaagccaagattgcgccattgcactccagcctgggcaacaagagtgaaactccatctcaaaaaaaacaattattaagaaggtggatctcacgttgagtgttcttactacaaaaataaatgaacacacacacaaaaacccagaaaacaaaaaagcaaaggtacacaaggaaacttttggaggtgatgtaaacctcctatctggatggtggcaatagaaacttgaatttataatatatacaaactcaccaaactgtgtatattaataatatgatatttttgtatactaataaactctaaataaaacagaaaaatgtgtagaattttacaagttttgaaatatatacataccagtgaaagcatcactgtaattaagataatgaacaaaattcatcagccccaacggtgtccccaaggcactgttcaccccactccccacccagacaaatattgttctgctttctatcactatagatgagtctgacttttctggagttttatgtaaatgtaactatacagtatattctctttttctgcctggattctttcactgagcataattattctgggattgatccatgttgtaatgtttatcagtttttattgatgaataatattccattgtagaaatattccatggctgtttattctttcacctagtggtgaatatttgtgttgcttcctttcagatttgggcgattgcaaataggctgctatgaatatttatgtacaaggctttgtatgaatgttgaggaaaagaagccgcaaagataataaatgtcttcatttatataggatacaacgtgaggcaaaattactctatggtattagaaattacaatactggttatcttttgggaagtatgatattattgtattagaaattacaatagtggttatcttttgggaagtatgatagtgactaaaagggtgcctgaaggggggctgcttttggactctggtaatagcgtgcttcttttttttaattgtattttatatcgatgcataatagatgtacatattttcagggtacatgtgataatttcatatattcatataatttgtaaagatcaaatcagtataattgagatatttataaccttaaatatttttcttttgtctatgctggaaacattcaaattattcttttctagctatttgaaatatacaatagatgattataaattatactcatcctcctgatctatcaaacactacatcttatttcttctatcaaactatatatttgtacccattaatcaacctgtttcttcatcttgatgtcgattacacagatggtcagtatatgaaaattcagtgagcatattttagatatttattattttataggtatcttatacatggattaaaagtgaggctgctgaaatggttgtggctagatctagatgattctctatacagtgcctgactggtatgcctgtttcttatttcaaagccttattactattccactcataaactcccagtatcctctctgtccttcctataccattgcctttatagcctgcactataattatttttttagtttaggtctttcttgttacactataaattttctgcaacaaaaaaaagagaaagtctaacttttcagctttgtttttattctgtggcatggtacttggtacagagtagatattccatggacccttagatgaatactataaagccttctttgttggttgcttatgcttctgctcaaaggttagcctctgagtcttcattatttgacttctactagagccttcagttctcctattgtctacaaattattgactaggttttgtgatattgagagattttcttccaattgtaatgctttgttttagcatcatttttccaatgataataagttgtgttattgagtacttaccatgtactctgtttaagcactgtacatctgctaccactctttgaagatgtacaacccaacaatattcccattttataaacagggaaactgaggtacagagaagtagaatgtcatatcacattgctagtaagtgacagaactcaaatttgattccagacaatctgacttcagtactcatgcttttattcagtttagtcttttatgtgtatatatgctatatcatatcattatgtttcctcacttcctttagaacttcaataaaatattagcttttcagagtggctttctttgggcactttacatgaagtagcatcccttacaatctgtctataattcttaccctgctttatttttttcacagcacttaccaccattctgtatgttgtatatttatttctacttccttcttgtacatttctccccacaataatggtatttccatgagggcagagactttatctgttttgcttttgactttactcctatctcatagaataaggcctgggacataataggtgtttaataaatatttgttgaacgaatgcatgaatgcttcatagaatcaatttatgctacggcattgtggtgctaagtacaaagggacagcaaaggtttataaaaaaaaatgttctagcagaatcattttctgcttataaaccaaaatggatctttattagacagaaacatggataccaatacatattccatgtagcacgattgaacatgccatgtcaatcttaatgcaaggccatttttgaagagtctttgaagatacagtgtcatgtgagtttttattctggggaaacttctggcaaatgggagttgaaagagagtttctatattacttgcattttgtcacttgcattttggaaagatttcaatggctgctccgtgcagagtagattatagcgggcacaatggaagacatggtaaccagttaacaaagttgtagtgttaatccatgggaaaattaactgaagccttgaactagagctataaagtagctatgtagatgagaaaggatgtgtttcagagagagtagaattcatagggcttggtgaataattcatcatggggtaaggaatacctcccaggtttctgttttagggaatatcaactacatagacagaaaataaggaaggtctggggagatgatgaattttgttttcaacataataaattggaaaggcacatggtatattcaagtggagccagtcagtagacaataagaaatttagacctagaactttgcacctgtggttggagagctatatttcaaagtcatcaaatgcctgaagttacatagggagattatgaagaatattgttcgattggattcatatgtaccacacaataactaactgtgattttagctgaaaaggactttaatgggaggaccttgaataaatgcaataattgatagcaagacaagttaaacttagaaactaagcaaaagcaattttaaaagaacactacagtgtaataccattgcaacagcaccaaacactgaatgccacagtttgcactggtactctgccagcgctgggcactggccactgctactgcatcatcagcttgcagtttctgttgctatcatcactgctgctgctgctgctgctgctgctgctcaaatgataatcaattctaagtggtcaggaacttctgtagatagtatctgtggaggataagaagcatgtgtctgacttgtatcgcctgagcgcccaattcactgacaccagaaaggattaaaagccaaatatctggtttctaagagggttaaaagttgagacccatcaagaagataccaccaaatatacttagttaacaacattaggtttattcattgctgctgcaacagagatcgtataccatggagaaccacgcagcatctcagtaagagggagttagaagggacctagagattatgttgaaagtgttcaaaaaatggggattatcactttgggattgggcattctctgaaaatgggacatttggctattggagattttagtatttttttatctgtgagcagaaggaatggaaaggagttagagttattggagaagcagcagtagtctctcatattagcagaagcacaaagtctttgtttttatctctattcaggcataattatgaagttgtcttgtttttattttgtatcattgtggtcacaaaaaatcgtcaatcattgatgatgtttcatggaattgtttatgatcagcagggaaataccatagcataggtggttgtaaccagaccagctaccagctgttcgctgtcagagatgctcttacctttctggagaggaaactttgcctcctaacaagactcctgaagtagagaattgccaaaatgccagatgccagggagccaataaaaagaaaaaattactaaagcctacaatttccaactattccatatcactgtaactcaggattcagcaaattgggtcagatagtaaatattttcccctttgtgagccatcaggtctccactgtaactactcagttctgccattgtaagcacaaatgcagccatagatgatacgtaaacaaatgatcatggctgtgttccaataaaacgattgctatggtttcagtgtggcccctccaaaattcaggtgttgccaatgtggtagtttcaacaggtggggcttttaagaggtgattaggctgtaaggactgctccctccttaataggattaagctgttttaaaagcggcttcgtgcagctcttcggccgtatgaggacttagccttcctcccttcttggagtgtacaacaagaagtccctcaccggatggcagtgccttgatcttggacttcccaatctccagaactgtgagaaaataagcttctcttctttataaatgacccagtccgtggtattctgttacagcagcacaaacagactaaatagctttgctgtaataaaatttattttatgaacactgaaatttgaaatgtatatccttttctcatataataaaatattattattttgtctttttccaactatttaaaaacgtaaaaaccattccaaatttgtaggctgtataaaaagaacagcggaccagatttggcctgcaggctatcagctgcaaacccttgctccaactaataaacaatattactgataggagtctgttgcctgtgagacgggtatggaagagagtcaatagtttttatgggatcacaagtacacatcatgtggatttggaagagaagtaatcataatagaggttccatttagttttggtccttatcataaaacccagaatctacatctgttttaatagcttttaaattaagaaatagtgataaactaacacttcatttttcttctttgtattctaggataaacttcttcccatacatttttaaaaattattatttattgatcagcttcagaggagagctctcagttggttgcatacaaatcaagagtgttgatattgttttcttatttttgatctataaaaattatgagttttattgtagcatacaatattcttctaaggtgccaaatcataataaatattctcctcaacaattctaccttaaaaagcaattactggttgagcatcactaatatgaaaattcaaaatccaaattctgaaatgctccaatgagcatttcctttgagcatcacgttggcactcaaaatatttcagattttaaagcattgtaggttttggattttcacactagggatatgcaacctgtattctaaattgcatgtttttaatctgaggagtcctctgagatgtatttaaaatggctagctttaatctcatgacctccaaaactaaatctaccagagaatgactcccatgagagaaccgaattcatttagccactataaatagttcaatatgcctgtaaattacaatgtatacagtggttttgcaggcaataaaaccagaaaggtaagctggtgtcaaattatgaagttccttgaatgcaatattgaggaatttagactttttctttaaataattgtatttctgagcccagaaatgatatgatcaaattattttggggtttactctggtgatgatgttatggattggaagcagctgaaagtggaggcaggcagactagtgaagaggctgttacaaatgcctgggttgccatcatccaagaagtaagaagggcaaaactaaaacagtggcagaggggatgaaaagagagtacacattcaagagataataatggaaatagaatacataggtgtttgtaactaattggagaatgacagagaaaaaagtttagaatagcttccatgtttctattaaagtctactgggagcatagtagtaatactcattaaaatagcaaatagagaagaggcaagttatttctccttgtttcatttgaactcctcccttttcttatggggaagtgggcttcctcatctagttttggtgctaacagttgttctccattcctaagaatgaaaccctgctcacagagtaaagtttcagcacagttttaccctgggaacatgacctactgtagcctgatagggaaataattgtctgaaccagccttctccaagagcaaattgctcttgagaaataactatctcttccttggccattaatgttaagaaaacaaaaatcatctttgatctccttcatattgcagagaactttattaaaaaaaactacattgctatttctaaaacatgcaaaatactttttacacttaactgaatgctgatgctagtgttattttctttgcttgggattcccattctaccttctccatctggtgaactcattatctcttaagccctaattccagtgttatcttatataaagccatctgtagatcaagccctgattacaagctctcatagtactctgacttctgggtatcatgattcccaactgtaataaattaatatattaatttcataataatttaatatctaaattgtatgatagaatgtatgctccatcagggcaggaactgtgtctgctttgttaatccttgaattgctatgacacacataataagacttcataatagccattattattactaattgggagcttttataactactccattaggttgtgaggacctgaaggcaacagccacatgttaatccccatccttagcccagtgcctggaatctaatacatactcaaatgatgtttgttaaattgattttaaaaattagttatctggttgatgaaattaaaaagctttaattgggaccaggtgtggtggctcacacctgtaatcccagcactttgggaggctgaggtgggcagatcacttgattccaggagtttgagaccagcctgggcaacgtggtaaaacctcgtctctacaaaacaatacaaaaattagccaggcatggtggcatgcatctgtagtcccggctactcaagagactgaggcacaagaattgcttgaacccaggaggtggaggttgcagtgagctgagattgccattgcattccagcctgtgtgacagagccagaccctgtttcaaaacaaaacaaaaaaaaaagcttcaattttcagagacgttataaagtgaagtatcagtatagtacaaaagtaaagagactagataatcaacttgttttgtccacatgataaaaataatgtgaagaatcagacttttcttgctctttgagcaattagccaagtgttatcacattgacaaaaaattaatctttattcaataaaattcaagttcagaaacatacttttttatgagagtatgttgaaaagcaatggttgatgcaagatttgctttatgtaactataattacccataagaaataatgcaattagacttcgtgtcttttacagttctttgattgaagtgagttttcattatgaggcacatttcacaatggtctcgtttagatttcttacccattgttatttttattgtacagtccattatttctgatagttgtccttttatattttatttcgcaacttccaaatgccaattgataatagtcatttttttagcatgataatctttatgacaaatgataaccatggcaaaaagttattcctggtcagggccaatcagaaagttatcctaagtgaaatttgttcttaagttgccattgcaccagagagctgggcaagatggttgaataggaacagctccagtctgcagctcccagaagagaccaacacagaaggcaggtgatttctgcatttccaactgaggtactcagttcatctcactgggactggttagacagtggttgcagcccacagagggcgagcggaagcagggtggggcatcgcctcacctgggaagcacaaggggtcagggaactccctcccctagccaagggaagccatgaaggactgtgccgtgagggacggtgcactctggcccagatactacacctttcccacagtcttcacaacccacagaccagtagattccatcaggtgcctataccacatgggcccttatagcactaaatggccacaagacaaagtgggaaagatttaaaatcaacaccctaacatcacaattaaaagaactagagaagcaagagcaaacaaatttaaaagcttgcagaagacaagaaataattaggataagagcagaattgaaggagatagagacacaaaaaacccttcaaaaaatcagtgaatccaggagctggttttttgaaaagactaacaaaatagatcactagccagactaataaagaagaaaagagagaagaatcaaatagaaacaataaaaaatgataaaggagagatcaccactgatcccacagaaatacaaactaccatcagagaatactataaacacctctatgccaataaactagaaaatttagaagaaatggataaattcctggatacgtacaccctcccaagactaaaccaggaagaagtcaaatccctgaataaaccaataacaagctctgaaattgaggcaataattaatagcctaccaaccaaaaaaagtccaggactagatagattcacagccaaattctaccagaggaactggtaccattccttccatatttatagacactattcacaaatataccagcaatataggttttagcaatcaaatggtaagagaataatctctaggaatatcttacatagaaggaataactgtgtggagtcataaacaagttgagtctgatgctatattattttaagaagaaacaacttacagaaaaagaatttttgagtaattttttggaagatacaataaatattaaaaaagaagaatactaatttgaaaaatgttaacatatttaattctgaagtaattaaaagtaaaagaaacaatgcatgtagaatcacagacatggtttctgaaaagaagaaattataaacttggaaatcactctgatatccacagaataattgatgaaaaaaccatgcaaatggaaacctagaatattggaaagttaaatgtggggaggaaaaaacataaaggatactctgaatcctaaatgatttataaaaatttcttttttagtatttcgagtaacataaaaaattatgcaaatatattgctatatattttctatttctttttaacttatttaaatgcactttctcctgatctttttgtttttttacatttttaaaaatttattttaggttcaggggtacatgtgcaggtttgttatataagtaaattgcatgtcacaggggtttgatgtacagattattttgtcacccaggtaatgagcatcatacccaataagcagtttttctattctcaccctcctcccacacacaacccttgagtaggccctggcgtctgtttcctttttcttgtccatatatactcagtatttagctcccacttataactgagaatatgcggtatttggttttctgtgcctgcattaatccactgaagataacaccctccattatgtataattacatatgtaacattctacatttacatcatagaatattacacagttatgaaaaagaactcagttatgtcctcaatggtagactttattctatctaccattgatgggcatttaggttgattccatgtctaattccatgtctttacttttgtgaatagtgctgtgatgaaaatacacatgcatatgcctttatgctagagtaatttatattcctttgggtatatatccaataatgggattgctggatcaaatggtaattctgttgtaagttctttttattattattattattattatactttaagttttagggtacatgtgcacaatgtgcaggtttgttacatatgtatacatgtgccatgttggtgtgctgcacccattcacttgtcatttagcattaggtatatctcctaatgctatccctccccgctcccaccaccccacaacagtccccagagtgtgatattccccttcctgtgtccatgtgttctcattgttcaattcccacctatgagtgagaacatgcggtgtttccttttttgtccttgcgagagtttgctgaaaatgatggtttccagtttcatccatgtctgtacaaaggacatgaactcttcattttttatggctgcatagtattccgtggtgtatatgtgccacattttcttaatccagtctatcattgttggacatttgggttggttccaagtctttgctattgtgaatagtgctgcaataaacatacatgtgcatgtgtctttatagcagcatggtttatagtcctttgggtatatacccagtaatgggatggctgggtcaaatggtatttctaattctagatccctgaggaatcaccacactgacttccacaagggttgaactagtttacagtcccaccaacagtgtaaaagtgttcctatttctccacatcctctccagcacctgttgtttcctgactttttaatgatcaccatcctaactggtgtgagatggtatctcattgtggttttgatttgcatttctctgatggccagtgatggcgagcatttgttcatgtgttttttggctgcataaatgtcttcttttcagaagtgtctgttcatatcattcacccactttttgatggggttgtttgtttttttcttgtaaatttgtgtgagttcattgtagattctggatattagcgctttgtcagatgagtaggttgcaaaattttttctcccattttgtgggttgcctgttcactctgatggtagtttcttttgctgtgcagaagctctttagtttaattagatcccatttgtcaattttggcttttgttgccattgcttttggtgttttagacatgaagtccttgcccttgcctatgtcctgaatagtattgcctaggttttcttctagggtttttatggttttacgtctaacatgtaagtcttcaatccatcttgaattaatttttgtataaggtgtaaggaagggatccagtttcacctttctacatatggccagccagttttcccagcaccatttattaaacagggaatcctttccccattgcttgtttttctcaggtttgtcaaagatcagatggttgtagatatgtggcatgatttctgagggctctgttctgttccattgatctatatctctgttttggtaccagtaccatgctgttttggttactgtagccttgtagtatagtttgaagtcaggtagcgtgatgcctccagctttgttcttttggcttaggattgacttggcgatgagggctcttttttggttccatatgaactttaaagcagttttttccaattctgtgaagaaagtcattggtagtttggtggggatggcgttgaatctataaattaccttgcgcaatatggccatattcacgatattgattcttcctacctatgagcatggaatgttcttccatttgtttgtatcctcttttatttcattgagcagtggtttgtagttctccttgaagaggtccttcacatcccttgtaagttggattcctaggtattttattctctttgaagcaattgtgaatgggagttcactcatgatttggctctctgtttgtctgttcttggtgtataagaatgcttgtgatttttgtacattgattttatatcctgagactttgctgaagttgcttctcagcttaaggagattttgggctgagacaatggggttttctaaatatacaatcatgtcatctgcaaacagggacaatttgacttcctcttttcctaatcgaataccctttatttccttctcctgcctaattgccctggccagaatttccaacactatgttgaataggagtggtgagagagggcatacctgtcttgtgccagttttcaaagggaatgcttccagtttttgcccattcagtatgatattggctgtgggtttgtcatagatagctcttattattttgagatatgtcccatccatacctaatttattgagagtttttagcatgaagggttgttgaattttgtcaaaggccttttctgcatctgttgagataatcacgtggtttttgtctttggttctgtttatatgctggattacatttattgatttatgtatgttgaaccagccttgcatcccagggatgaagcccagctgatcatgatggataagctttttgatgtgctgctggattcgatttgccagtattttattgaggatttttccatcaatgttcatcaaggacactggtctaaaattctcttttttggttgtgtctctgtcaggctttggtatcaggatgatgctggcctcataaaatgagttagggaggattccctctttttctattgattggaatagtttcagaaggaatggtaccagttcctccttgtacctctggtagaattcggctgtgaatccatctggtcctggactctttttggttggtaagctattgattattgccacaatttcagaggctgttattgatctattcagagattcaacttcttcctggtttagtcttgggagggtgtatgtgtcgaggaatttacccatttcttctagattttctagtttatttgcatggaggtgtttgtagtattctctgatggtaatttgtatttctgtgacatcagtggtgatatcgcctttatcattttttattgcgtctatttcattcttctctctttttttctttattagtcttgctagcggtctatcaattttgttgatcttttcaaaaaaccagctcctggattcattaattttttgaagggtttttttgtgtctctatctccttcagttctgctctgactttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatgttgtgtctttgttctcgttagtttcaaagaacatctttatttctgccttcattttgttatgtatccagtagtcattcaggagcaggttgttcagtttccatgtagttgagcggttttgagtgagtttgttagtcctgagttctagtttgattgcactgtggtctgagagacagtttgttataatttccgttcttttacatttgctgaggagagctttacttccaactatgtggtcaattttggaataggtgtggtgtgtggtgtggtgctgaaaaaaatgtatattctgttgatttggggtggagagttctgtagatgtctattaggtccacttggtgcagagctgagttcaattcctgggtatccttgttaactttctgtctcgttgtcgggtctaatgttgacagtggggtgttaaagtctcccattattattgtgtgggagtctaagtctctttgtaggtcactaaggacttgctttatgagtctgggtgctcctgtatcgggtgcatatatatttaggatagttagctcttcttgttgaattgatccctttaccattatgtaatggccttctttgtctcttttgatctttgttggtttaaagtctgttttatcagagactaggattgcaacccctgcctttttttgtttccatttgtttggtagatcttcctccatccttttattttgagcctatgtgtgtctctgcacgtgagatgggtttcctgaatacagcacactgatgggtcttgactctttatccaatttgccagtctgtgtcttttaattggagcatttagcccattttcatttaaaattaatattgttatgtgtgtatttggtcctgtcattatgatgttagctggttattttgctcgttagttgatgcagttttcttcctagccttgatggtctttacattttggcatgtttttgcagtggctggtaccggttgttcctttccatgtttagtgcttccttcaggaggtcttttagggcaggcctgggggtgacaaaatctgccagcatttgcttgtctgtaaagtattttttttctccttcacttatgaagcttagtttggctggatatgaaattctgggttgaaaattcttttctttaaacatgtttaatattggcccccactctcttctggcttgtagggtttctgctgagagatccgctgttagtctgatgggcttccctttgagggtaacccgacctttctctctggctgcctttaacattttttccttcatttcaactttggtgaacttgacaattatgtgtcttggagttgctcttctcggggagtatctttgtggtgttctctgtatttcctgaatctgaatgttggcctgccttgctagattggggatgttctcctggataatatcctgcagagtgttttccagcttggttccattctccccatcattttcaggtacaccaatcagacatagatttggtcttttcacatagtcccatatttcttggaggctttgtttgtttctttttattcttttttctctaaacttcccttcttgcttcatttcattcatttcgtcttccatcactgataccctttcttccagttgatcgcatcggctcctgaggcttctgcattcttcacgtagttctcgagccttggctttcatctccatcagctcctttaaggacttctctgtattggttattctagttatccattctagttatctctcagctcgtcaaagtcattctccgtccagctttgttccgttgctggtgaggaagtgcgttcctttggaggaggagaggtgctctgctttttagaggttccagtttttctgctctgttttttccccatctttgtggctttatctacttttggtctttgatgatggtgacgtacagaagggttttgtgtggatgtcctttctgtttgttagttttccttctaccagacaggaccctcagctgcaggtctgttggagtttgctagaggtccactccagaccctgtttgcctgggtatcagcagcggtggctgcagaacagcggtggctgtagaacagcagaccttggtgaaccacaaattctgctgcctgattgttcctctggaagttttgtctcagaggagtacccagccgtgtgaggtgtcagtcttcccctactgggaggtgcctcccagttaggctgctcgggggtcaaggacctgcttcaggaggcagtctgcccgctctcagatctccagctgcatgctgggagaaccactactctcttcaaagctgtcagacagggacatttaagtctgcagaggttactgctgtctttttgtttgtctgtgccctgcccccagaggtggagcctacagaggcaggcaggcctccttgagctgtggtgggctccacccagtttgagcttcctggctgctttgtttgcctaatcaagcctgggcaatggcaggtgccccttccccagcctcgctgccgccttgcagtttgatctcagactgctatgccagcaatcagggagactccgtgggcataggaccctccgagtcatgtgggggatataatctcctggtgtgccgttttttaagcccgttggaaaagcacagtattagggtgggagtgacctgattttccaggtgccgtctgtcacccctttctttgactaggaaagggaactccctgaccccttgcgcttcccaagtgaggcaatgccttgccctgcttcggctcgcgcacggtgcactgcacccactgtcctgtgcccactgtctggcactccctagtgagatgaacccagtacctcagatggaaatgcagaaatcacccatcttctgcatcactcacgctgggagctgtagactggagctgttcctattcggccttcttggctccaccctgttgtaagttctttgagaaattgccaaactgctttccacaatgactaatctaagttatttccccatcaacagtgtttaagtgttcccttttctccacaacctcaccatcatctgtgattttctgacttttagtaatagccattctgactggtgtgagatggtatcttatctgactggttgttttgatttgcatgcttcctccctcttaaatcatggagggaaatcttcctcacaatctcctccagcagagtcctcttcctgtcccagtggccagaactaggtcataagttcatgtcctagttgcaaaagaaatttggatgatgactatatgacatttctcatctctgatgcagggcaggttctgctggcaagtaagaaaggtagttgcatgggaaatagccatggctactttggcagattacttttaaaggtccttagcctctaaagtttaaattctctgacagcttagtcacggagttatgcctatttgatacacccgtcagggtatcaacaatctaaggccaaactctgtaaaagcacggttagacctctgcagatagaaaatatttgaaaaaaaaaaaactacaataattttaaaaatacaagtaagaaaacaacacagtataacaaatctttacaaagcatttacattgtatcatgtatttacattgtattaggtatttaaagcatacaggaggatgtgtgtaggttaggtgcaactactatgccattttgcagaaactagagtatcagtggattttttatatccatgaaggtcatggaaccaattcccccaaggatactgagcaacgattgtacataaatattaatactcagaaagcccaatataacaagtaataactttttcaataaaatatagccagaaaacaatgagcctgacacattgtgtgtccttgtatatgcacacatgcatatgtatgtgttaaaggggtcttttagaaaagaaactttgtggtggtggtggtccttgcccagttatctacaagagttttaaaacagcttaacttggcttaactattttttcagtaacattcaacatctcttcataagcatataatataggttgcaatatgttctaatgaaaatgggcatattagtaactgattatgtttctcataaccttttgattggactgctgctttatgcattctaggaccttcagctctgacagagtagccccccaccctcagaaataatgtcattgttcttgcttatagggcaccttttccctcacaaagagctcaaaagttctatcaagcatgattatatctttgctgtgtaatcgtgagttaggactgcacaataattttcagtcagtggaaaattcatgtacagcatgaatgaataattggttctggttataaattcaagaagactatatagaaagtaataaaattcaggtttctcttcagtctaattaaacccttcattaaaagcagtagtgcagtatttgtcctatagccagttgctgttattaaggtacaattttacaacttaatctttctgttttttttaacaaatataccttactgtataaacaagatgtattcttaaaaggttactaatgaagttacttctttgtacagaatctttttttcgtattgtgcattaaactagagataatcataggaaagaaaactttttcaataagacatcacaaaattaacctaaactgttcaatgttgaatatctaaaaggaaaaaatatttcctaaggaaatcctcaaaatatgtgacagcttaatgcaaattatatattttcaatgtttatcctaataatttaaatattgcaaggagtaataccttaactgataaacattaacaaagtggtttaaaaaattaggtctttccaatattctttcacaaaataatagatgtttaatttggtcacatatccttttggaagatgccataagccagtttgactttttgttgttcttgagggaagttgagttgaaatgctgaaaagtacaaacaatcacagctgtgactttggtttaagatatagtattaactaaagaaaacatttgataatagaaattatgttttatctgccatcagacactaggtatttaatgtttcctggtttataacaacaataagttacatattctcataatgaggtgttccagaagtttcctttttttttgttttttgtgagatgggagtttcactcttgttgcccaggctggagtgcaatggtgcgatctcggctcactgcaacctccacctcccgggttcaagcgattctcctgccttagccacccaagtagctgggattacaggcacccatgaccacgcctggctaattttttgtatttttagtagaaacgggactttaccatgttggccaggctggtctcaaactcttgacctcagatgatccacccacctcggcctcccaaagtgctgggattactgatgtgagccactgtgctcagcctgagtttgcatttttaaagaatataaaatcctgggccttgcagtcttcagtaactgtgctgtaaagagcaatttatttctaaaattttataatatgcagtttattcaaagagatgaattaataacaagagaagaccatgattatgtgataaaattgacaggtctaaatcataaaatccaaatgtccattaaacacaggacacagactaagcaaagtgaaaaaattctttttttaagtgtcattaagagagagacatcagacagcaataactgggagaagttttcctgtccttgtgccatgaatagccagtaattggaaagagtgagcacatttgaaaaacaagttaaaaactggaatgcataagtccatgccaaaaatttgcagaatcctgagtcagcaaatccaagttgctgcactggaaatttatgggaaaacaacattccagccaaattcatgtggcttcagaggtaatcgtacatttaaatggataaaacctctgaatctaatagaaagaaaatcatagattgtacaattttgtcaaagtgacagatgtaccaaaatattgcataaattccatcactgcttcaactggaatattttccagctttgcaatcggataaatgctgtaaagtgatagcatgataggaaggacttaattttaataaatgcaaccaaaatgacggcattaagagcaaatgtctctggattccagcagtgttcctcattatttgaaataatacatacatataaatagttaaggatttcaaataatacacaaatataaatagttatctagtgacaattttataataataaatattctcaatccttaatttatctgttatatctttattcatggtctggaaacttaaatattcttagactttaagaacaggtatagaatagggttgatagactatgtcttgtccaaatctggcaagtctgtttttgtaaataaagatttgttgcaacaaaaccatgtctatttgttaacatatcgtgtaatataacaatggtagaattgagtagagacagagaccatatggactggagagcctgaaacatttgcaatgtggccctttacagagaatgtttgctgactcctggcatagaatatagtgaactgtagagcacatatttttcataaaaacattcatatttaaacaatggtcaagccagacaaaacaggccagattcagatgactggccagtgctagaaaaagagatgaagatcctgtgtcagcactgtcactaattttctgtgtgatatggagcaagtcaccaattctcctctagtaaaaagggagtgtctccctttgctgaggttacagtgcataaggccaaatggcaaaaccacatcatctttaaggggaatgtgacactaagccaaagaactatgtccaaaataatcataaatgcaaggagagcctgaagtgaatattgggagcggaggcgcagagcctaacaggtcagagtttcaagcaggcaaatgaggatgatctaatctaatttaaatactcacaataacctacttaaataaacctagggctgtgttttcataaattaagtatgtctatgatttcacagactgagatacacaagaactgtttcatcttctgcaaaatgaagttttgatagaaaaacttctggcaaagtgtgcttctagtctaagaaatgtcctgcaggaaacaaagaaagaaaaagttccttggttacataaacaggaagtagtttaaactatttccatctgttagagattcacaacgaacatttgtatattttgtctgagaagtcctgccaataagaagcgtaacatttttttcaacaagctttgccaaaatgtactggccatctgaaattttttaaaaatcatgcaacacttataaatccttggaaaaactttagaaaacactttcttagacgatctctaaagctttttcaaactctgaaagctttcactaagtattttaataactaacacagagagtatttatcatgtgtcaggcactatttacatggtttacctatattaactattttaatcataacagtaaccctataacatagggattcttattatcattcttatagatgacaaaactgaggttcaaagatgttatttagcttgttcaaagtcaaacagctagtgagtggtggaaccaggattcagacccaggtagtttgagtccagggtccgtggtcttagctattttatatatatataaatttatatatatattttatatgtatattttatatatataatatatatattatatacatattttatatataatatatatattatatacatattttatatatataatatatatattatatacatattttatatatataatatatattacatacatattttatatataaaaataaaattttattatgtataatataaatatattttatataaaataaaaatataaatataaaatataaatatatatcatatatattatatatataaaactatatatatatatagttttgttgttgcacttcagatattcagagaagtaaaaactacctaaacatctcacccaatatttcttttatcatttgaatttttaaaaaacctattattggaaatgtcaggaagttaacacaagatttgaacatacagagactggtgcactttgccttatctgcctttagctccatgcatattccacaataagtaaactaacgtatcctcattatagtattcattaaaataggcctgtcaggatttttcattgaccattgttaattaattatagctgcctccttggcaactatcaattaattatagatgcctgatagaaattgcgtggtttctctttgtaaatattctagaattccagcttcttactggtaaagaatcattcattcatgcctgtgtaaatgtcttcatttaaccgtcactggttgagaagctatttatgttgtgaataacattggcaagttacttgcgctcacggactttaaatctagcagagggagaaaaacaacaaataaacaaataaaaactaagatattttcagtggtgttaataagaaaataaaatagggtaatatataaaatgaaggcaagaaggatagtttattttggttggtggaaaatggactaacttatgagctgagatgaggaaaagggactggctatgagaagatttacaggaataacattacaggcaggagcaacagcaataataaaagcaatgatttagaaattttacacatttcaacaattttacatgtataatgtaactatagattggtaaatatttaataccaccatttttattagaactttctccttaagataactgagttaatatgcaaatgagtctaaataatcagcaagatatttggttcagagggatgaagttcaaatagttagcattactgatggagaatgtgtgccaaacttgtgatcaagtcctaatatttgctccgtgacctacagtagagatcatatcttcaggttcagctatttgtatagggaaatcacaccaatggacttccatgtggagaaagggagataggccccagagccaccagtgcttactttcatgaagaaggcgtagagccaatgagtgcattcctcaggtaggctagtttgaatagctaagggaaagccacatgggaacccacctagtagcataaggaggtaacaaatggaggtaagatgcttacttttctgacaatcagtaaagagaggagacatttgacaatgtctggagacattgtgatggtaacaactgtaaagagtgctgctggtatctagtgggtactttggatgctgctaaacatcttagagtgcacaagatagtcccccacaacaaacaattatctcatacaaaatgtcagttgtgccaaggttgacaaacactacatcccagaagtttccttttccattcatgagagtaggacaatagactttcctgcaacatactctaatgggaatttttagagcttcttcactttggaccaaaatcttttaaatcctttgaggttgtattgcatatataagattatgtgcataatgctatctcgagctacaatctcaaaaaaatctgttgattatatctcaactttagaattactctttcagtattttcattatttctctttacatttgcaagtacatgtgattttcataacaagtttctctaaaacctagctcaaatgccacttcttaaaattattcctaattactgaactgtttgttgttccttcttctgtgttcctatagcaatctatccatacttttatcgtggcacttgtcactctatgaagtaattatttatttaaaggtcattcccatttagaaaataagcccttcagagcagaggctgtgtaggatgtgctaaacatcctacaatgcacacgatagccccctatgtcaaagaattaaccagtccaaaatgtcagtagtgctgaggtggagaaaccctgcgtctctggaatctttgtaactccagtgcccacagggcgcctgccacaaagaagcacgttataggaatgaatgaatgaatgattgctcacaaagaacaatactaacataaaaataccatgagttctattttatttttctgagaaaatcttacttgtttgtatgctcatgaaattaaaaaccctgttacatatgttcatctaaaaggaacattttttttggacaatttgacagaatgattatagtttagcaactggcacacgaacaagaaaagtaatagactgtgttatggactgtctaaaatcttgtgggtaagtgaagacagtcaaacttagaagagtgaaatacagccaataatactgaatgccatctctgaaaacagaaataagaatgtaatattttaaaggtacaaaacgtagggaaacagcagaaagacaacttcaaaagtggaaaatgtagtgacagaatgaaactatagtgatgataattaaaaactgatggaaactacggtcatataaataaaatgagataaaattaaaatagaagaaatggtattttaaataaataagcttcaggaaatgggtcataaaaccctatgggacagcttttctttcccccagaacaagcaaaagaaaattgttgcccattcaaaagactgtcaaaggaatagtaggaagctatattataaattttaaaatatggtttcccgggcatgaagttatgaaccaaaggtttcaaaagcaatagaaaaagacttagaggtggcatagagtgtacctttcttcccacaaaaggaatcgatcaaatttaaactacactaatataaaggtaagaaataattttttttaatacattgtcttggtcagaaagtatctacagagtagagtttaattctaactgccaccaggccctcagagataggaaatgtttcaggctctgcagtccatagggtgtcattctcaactattcagttctgtggttgtagtacacaagcagccaaatgtatttgctagatacattagcaaataaatatgaccgtgttccaataaaactttatttacaaaaacaagagcgtgaggaggaaagatggcggacgaggagaaactgccgcctggctgggaaaagcgcatgagccgcccctcaggccgagggtactacttcaaccacatcactaaccccagccagtgggagcggcccagcgggaacagcagcagtggcggcaaaatctggcagggggagcccgccagggtccgccgctcgcacctgctagtgaagccagtcaaggcggccctcgacctggcggcaggaaatcacccggaccaaggaggaggccctggagctgatcagcggctacatccagaagatcaaggcaggagagaaggactttgagtctccggcctcacaattcagcgactgcagctcggccaaggccaggggagacctgggtgccttcagcaaaggtcagatgcagaagccatttgaagacccctggtttgcgcggcggacgggggagatgagcgggacagtgttcacggattccggcatccacgtcattgtccgcacggagtgaggattgggggcccaggcctggcctcggggttcccccgctgcctgctggccagtggccgaaccccccactccctgccactgtcacacagtatttattgttaccaaaatggctgggagggggcccttccagactgggggcccttccagactgggggccctggggttccccactccctgtcagtccccagttggggctgcgacctccagactctccattaaggagttgacttcagcatgggagggaggctcgcagacccagggcaatgtggtgggaggagtgttccaaagagaagatctggtcagcagagccgccccatgtcccaccaggtcctggaggcagatgcgagggcccagagttgtttgtagttaggccacgcttctctgttcagtagcaaaagcaaacactcgtgggcccagctgtgggccctctgagcaactttgcagcaccctttcacccccaattaaatccggaaccactaaaaaaaaaaaaaccaccaaggatgccagatagacttgagcatgctctgttttggaaaataaacattggcaaattttagtaagtctaaattgaataatcagtgtgtttaggagtctggaaacactattatacaagggatttaagagatcattaatatttatcctatacaaagataagtcctattactaataaaatattccttaatacactgaagcataagatatcactcattttttcttttaataaaattagttttgtcttgggcctcaaccactggactggcaaaaatccactctcagctttatatcatactctcctgggacatcagtgagaactacggaattcatagaatcccagaaattgcagaaagacctctggtctttagctcattatggttctcactagaatacatgttgcctagaactatacagtcaagtcaaaagcaggtgacctactattcctatgagcatttcttattcacttgacacacttagttacttggtccttcatctgggcccccaatactttggtgcttattgtttgtttgttgggtacgtggtctcagagtaaggtttgagagaatctgccactccatattcccaggctcagaagacaatttaattctctcctcatgggccccaactattccccaagcccctttccctggaagcacctattcagtggtatagatttagtgagaggtgtagcagatgttctccttaaaacattggccaaggtttcacaaccatctttgggctgctggtggtcccacacaggacattctgggtatcttgaaacatattttaagatctggggggagaaaggagactgatagatttggaaaaagtaacaattcaagaacgtgtgtggtaaactccaagttaagtcatgcaaaaggaagaaaatggaatgtgggtttaaaaggagagttcgttttcaggtagagtagataagattttattcctcgagtctttatttccagtgaagactttttgcctgagctccagacacacacatacacacacacaaacacacacacacactttttcctaatataagtgtcttgcattcacctcaaagccaatatagtatttaaaatacaatccattacattcaacctatctccaccttagatttattccattctaatatactctcactcctattcaactaagagactatctttaattttttcctctcctttacatctgacatccaatcagtcatcatcattaatcaagtcatgtctttttccaaagcatctctcctatctgacatcacattattcatattgccattgccttatttctggccccaattatatcccacatgaatttcaaaacagtctgttatctggccttatggctaacatatcctgtccccattgcccacatcattccaagttgctgatgtgagctttctaaaataaaaacctggtatctttttcctacctgaatcttaaagccttccattgccttcaagctaaaactcaaattccttagcttgacacaggagataatctcatgatctagtgcttacctacatattatttcttactacttcctaccatttttcttatttcttatcaattcttacattcattctgtttgtttgtttgtttgtttgagacgaattctcactcttgtcccccaggctggggtgcgatggcactatctcggctcactgcaacctctgcctcccagattcaagcaattctcctgcctcaaccttctgagtagctgggattataggcacctgccatcatgcctggctaatttttgtatttttagagagacgggggtttcaccatgttggccaggctggtctcgaactcctgacctcaggtgatccacctgcctcggccccccaaagtgctgggattacaggcatgagccaccgtgcccggcacatttttcttactattcctgctaacctgcagttccttgaatgcaccatgatctcttccatcctacctctttgacattttctcctgaaatgaccatctcccctgactcctccaaagtaaagcttcagtaaagccttctattttctattcctaccttccccaaggctgaaaaagtacctctcctttttgttctctagcaacctacacgtatgatttttacggcaaatgccatattgggtagaaattgttcattccacttgtaatttctctcgattatgaactacttaatactggggacaacacctttcatctttaaaaccttaaacttgggagaaaatagaaaatcaatgtatttttgttatggaataaataattttgagtgataaatgggtaaaaagcatattggatagaagaaagagcattggcaaaagcttacaacttctaaaactaatcatctcaaaattaccactaatctccatgttgtcaaattaagtggtcagttctcagatctgtcagcggcttttgtcgcaattggtcatagcatccacctcgaaatactattcttttttttaatttttttaatttttttattttattattattatactttaagttttagggtacatgttcacaatgtgcaggttagttacgtatgtatacatacgccatgctggtgtgctgcacccattaactcgtcatttagcattaggtatacctcctaatgctatccctatccctcccccctcctgccaccccacaacagtccccagagtgtgatgttccccttcctgtgtccatgtgctctcattgttcacttcccacctatgagtgagaacatgcggtgtttggttttttgtccttgcgatagtttattgagaatgatgatttccaatttcatccatgtccctacaaaggacatgaactcttcattttttatggctgcatagtattccatggtgtatatgtgccacattttcttaatccggtctatcattgttggacatttgggttggttccaagtctttgctattgtgaatagtgctgcaataaacatacatgtgcatgtgtctttatagcagcatgatttatattcctttgggtatatacccagtaatgggatggctgggtcaaatggtattactagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctgtgagcatttgttcatgtgttttttggctgcataaatgtcttcttttcagaagtgtctgttcatgtcctttgcccactttttgatggtgttatttgtttttttcttgtaaatttgtttgagttcattgtagattctggatattagccctttgtcagatgagtaggttgcgaaaattttctcccattttgtgggttgcctgttcactctgatggtagtttcttttgctgtgcagaagctctttagtttaattatatcccatttgtcaattttgtcttttgttgccattgcttttggtgttttagacatgaagtccttgcccatgcctatgtcctgaatggtaatgcctaggttttcttctagggtttttatggttttaggtctaacatttaagtctttaatccatcttgaattaatttttgtataaggtgtaaggaagggatccagtttcagctttctacatatggctagccagttttcccaggaccatttattaaatagggaatcctttccccatttcttgtttttctcaggtttgtcaaagatcagatagttgtagatatgcggcgttatttctgagggctgtgttctgttccattgatctatatctctgttttggtaccagtaccatgctgttttggttactgtagccttgtagtatagtttgaagtcaggtagcatgatgcctccagctttgttcttttggcttaggattgccttggcgatgcgggctcttttttggttccatatgaactttaaagtagttttttccaattctgtgaagaaagtcattggtagcttgatggggatggcattgaatctataaattaccttgggcagtatgggcatttttacgatattgattcttcctacccatgagcatagaatgttcttccatttgtatcctcttttatttcattgagcagtggtttgtagttctccttgaagagttccttcacgtcccttgtaagttggattcctaggtattttattctccttgaagcaattgtgaatgggagttcactcatgatttggctctctgtttgtctgttattggtgtataagaatgcttgtgatttttgtacattgattttatatcctgagactttgctgaagttgcttatcagcttaaggagattttgggctgagacaatggggtttcctagatatacaatcatgtcatctgcaaacagggacaatttgacttcctcttttcctaattggataccctttatttctttctcatgcctgattgccctggccagaatttccaacactatgttgaataggagtggtgagagagggcatccctgtcttgtgccagttttcaaatggaatgcttccagtttttgcccattcagtatggtattggctgtgggtttgtcatagatagctcttattattttgagatacatcccatcaatacctaatttattgagagtttttagcatgaagggttgttgaattttgtcaaaggccttttctgcatctgttgagataatcatgtggtttttgtctttggttctgtttatatgctggattacatttattgatttgcatatattgaactagccttgggtcccagggatgaagcccacttgatcatggtggataagctttttgatgtgctgctggattcggtttgccagtattttattgaggatttttccatcaatgttcatcaaggatattggtctgtaattctcttttttgggtgtgtctctgcctggctttggtatcaggatgatgctgacctcataaaatgagttagggaggattccttctttttctattgattggaatagtttcagaaggaatggtaccagttcctccttgtagctctggtagaattcggctgtgaatccatctggtcctggactctttttggttggtaagctattgattattgccacaatttcagaggctgttattggtctattcagagattcaacttcttcctggtttagtcttgggagggtgtatgtgtcgaggaatttctccatttcttctagattttctagtttatttgcatagaggtgtttgtagtattctctgatggtagtttgtatttctgtgggatcagttgtgatatcccctttatcatttttattgcgtctatttgattcttctctcctttcttctttattagtcttgctagcggtctatcaattttgttgatccttgcaaaaaaccagctcctggattcattaattttttgaagggtttttttgtgtctctatttccttcagttctgctctgattttagttatttcttgccttctgctagcttttgaatgtgtttgctcttgcttttctagttcttttaattgtgatgttagggtgtcaattttggatctttcctgctttgtcttgtgggcatttagtgctataaatttccctctacacactgctttgaatgtgtcccagagattctggtatgttgtgtctttgttctcgttagtttcaaagaacatctttatttctgccttcattttgttatgtacccagtagttattcaggagcaggttgttcagtttccatgtagttgagcggttttgagtgagtttgttagtcctgagttctagtttgattgcactgtggtctgagagacagtttgttataatttccgttcttttacatttgctgaggagagctttacttccaactatgtggtcaattttggaataggtgtggtgtgtggtgtggtgctgaaaaaaatgtatattctgttgatttggggtggagagttctgtagatgtctattaggtccacttggtgcagagctgagttcaattcctgggtatccttgttaactttctgtctcgttgtcgggtctaatgttgacagtggggtgttaaagtctcccattattattgtgtgggagtctaagtctctttgtaggtcactaaggacttgctttatgagtctgggtgctcctgtatcaggtgcatatatatttaggatagttagctcttcttgttgaattgatccctttaccattatgtaatggccttctttgtctcttttgatctttgttggtttaaagtctgttttatcagagactaggattgcaacccctgcctttttttgtttccatttgtttggtagatcttcctccatccttttattttgagcctatatatttctctgcacgtgagatgggtgtcctgaatacagcacactgatgggtcttgactctttatccaatttgccagtctgtgtcttttaattggagcatttagcccatttacatttaaagttaacattgttatgtgtgaatttgatcctgtcgttatgctgttagctggttattttgctcattagttgatgcagtttcttcgtagcctcaatggtctttacattttggcatgattttgcagtggctggtaccggttgttcctttccatgtttaatgcttccttcaggaggtcttttaggacaggcctggtggtgacaaaatctctcagcatttgcttgtctgtaaagtattttatttctccttcacttatgaagattagtttggctggatatgaaattgtgggttgaaaattctttcctttaagaatgttgaatattggcccccaatgtcttctggcttgtaaagtttctgccaagagatcccatgttagtctgatgggcttccctttgtgggtaacccgacctttctctctggctgcccttaacattttttccttcatttcaactttggtgaatctgacaattatgtttcttggagttgctcttcttggggagtatctttgtggcgttctctgtatttcctgaatctgaatgttggcctgccttgctagattggggaagttctcctggataatatcctgcagagtgttttccaacttggttccattctccccgtcactttcaggtacaccagtcagacatagatttggtcttttcacatagtcccatatttcttggaggctttgttcatttctttttattcctttttctgtaaacttcccttctcacttcatttcattcatttcatcttccatcactgataccctttcttccagttgattgcatcggctcttgaggcttctgcattcttcacgtagttctcgagccttggctttcagctccatcagctcctttaaggacttctctgtattggttattctagttatacattcatctaaatttttttcaaaatttttaacttctttgcctttggtttgaatttcctcctgtcgttcggagtagtttgatcatctgaagccttcttctctcaactcatcaaagtcatacgccgtccagctttgttccattgctggtgaggaactgcattcctttggaggaggagaggcgctctgctttttagaggttccagtttttctgctctgttttttccccatctttgtggttttatctacttttggtctttgatgatggtgatgtacagatgggtttttgctgtggatattttttctctttgttttccttctaccagacaggaccctcagctgcaggtctgttggagtttgctagaggtccacacgagaccctgtttgcctgggtatcagcagcggtggctgcacaacagcggattttcgtgaaccgtgaatgctgctgtctgatcgttcctctggaagttttgtctcagaggagtacccggccgtgtgaggtgtcagtctgcccctactgtggggtgcctcccagttaggctgctcgggggtcaggagtcagggacccacttgaggaggcagtctgcccgttctcagatctccagctgcgtgctgggagaaccactgctctcttcaaagctgtcagacagggacgtttaagtctgcagaggttactgctgtctttttgtttgtctgtgcactgcccccagcggtggagcctacagaggcaggcacgcctccttgagctgtggtgggctccactcagtttgagcttcatggctgctttgtttacttaagcaagcctgggcaatggtgggcgcccctcccccagcgttgctgccgccttgcagtttgatctcagactgctgtgctagcaatcagcgagactccgtgggcgtaggaccctccgagccatgtgcgggatgtaatctcctggtgcgccattttttaagcccattggaaaagagcagtattagggtgggagtgacccgattttccaggtgccgtctgtcacccctttctttgactaggaaagggaactccttgaccccttgcgcttcccaagtgaggcaatgcctcgccctgcttcggctcgtgcacagtgcgctgcgcccactgtcctgcccccactgtctggcactccctagtgggatgaccttggtacctcagatggaaatgcagaaatcacccgtcttctgcgtcgcttacgctgggagctgtagaccggagctgttcctatttggccatcttggctgccagcctctgaaatactgttcttatttggcttccaggactttacattcttcttattttttctcctatgtccctagtcacttttcagttttacttatttgttcttcatatccattcagacctattctctttttatctacattcatgcccttggtgatctatattctcaagacctcacaatagtattttttcttcatctgttataggtaaatgcacaaactggcccagttggaaagacttgacctaggcaataatgaattcagtgagctggtaagccatctctatgctaccatgctcaaattatgtctttcctagactcttttcttgatgtctatgcttgtttatgcaactgaatgattaacatctctagttgactctagagtagaaatttccaactgaacacctaaaactgaacttccagtctacccaaaaccctgctccacttggtcttcctcatcagtcacttgcaactccatccttctagttgttcagaccaaaacacacctttagtcacagtcagctctcattccccacagctgactcatcaagacatttagttcttatcttaactatatccagaaccctaccacatctcagcacctttaccattgccttattatggccaccactgtggccataaattttttataataagaaagaagtaaaatagattcagtccaagccaccatcacctcttatttgacttattacattagccttctctttgatcttccttcttctactgttgtccccctcagtctgtttataagcctgcaatcacagatattcttctaaaacaaatcatttcagaaacatctttcataaaaacctttcagtggccccctatcctactcagaatcaaagccaaagtctctacattgtgctgtaagatcgcatattatgcaactccccattacatcatctttctactcctccctctctctctcttctttagccatactggtctgctaggatgtcttcaagcaagtaaaatgtccctgctttagaatctccatattagcatgctttttcatttcctttctgccttggctccaatttcgtattctcattgaggccttacctgatcaccctactaaaaattaaatccttatatgaattctctctatctacctcctctgcttaacttttctctgtagcacttgtaaccttttaatatgttattttattttattttattattttgtttactctgattcttccctgctgaatgtaaagtcctttgaggtaggaatttttatctgttttgttctctgccataccccagatcagcacataatactctctcaataatagttgctgagtgaagaaagagtacataatttttttgcatttctgagtatctgatagcatccggattgcagtaatatttcatttaaggttcataaaagccctataaggtaatttctacatccattttaaatgtgataaaactaaaatttctaagatttcaatcaatggtgtctgaagaattcctgtataggcaggacttaaggacagaattctgattagtggagagataaaaaaaaatctttcagaaaagcactgtattttctcatagtgtatgtttacttgagagtgctttgagaaatgctgactgcatatggagtgcacttgggttccctgaacttttgacatcaactcttgcccaaggtttgtgtattagtctgttttcacactgctataaagaagtgctccagactgggtaatttatatagaaaagaggtttaattgactcacagttccacatggctgggcaggcttcaggaaacttaaaatcatggccgaaggggaagcaggcacatcttatatggcagcaggcgagagagaacatgtgaaggaggaactgtcaaacacttataaaaccttcagatctcatgagaattctcactttcatgagaacagcataggagaaaccacccccatgatccaatcacctcccaccaggtcccttcctcagtatacgattatggggattacaattcaagatgagatttgggtcaggacacagaccaaaactgtatcagtgtgacaactattcatagctatagcagctttcaagtcaatatgtttgggagacaatgactacaatttgtctgtaacagaagttcatttaaaggagtagaaaataataagactgatgatgaaatggtgccatattatgagattttagaatggtttgctgagaattggtttcagccattgattcccaatcctgtggtgactcttaaaaatattgaagtggggccccaccctacacctcccactggtgtagatatttaataagcttcttggatttttgttaaggagccagccttgcatgccaaccatattggcatttgtgaacagatgctgtagcttttcagctggcagtttgcatagattttgtgtatttgagatttacttgttgctgaagagtacccccagttttgtgtactacgcaatcaggtaaatctgacaggaaggtggttggaatgtcttttagagcaatgtatcatgcactacctcacaatagtatttttctccatctgttgtaggtcaatgcacaaactggcccagttggaaagacttgacctaggcaataatgaattcggtgagctggtaagcaaatgcattttctaaacctgataaatacccttcaggagattctttcttttgctctgtctttgtaaaccaaggtattaacttgattgcacgtttgcatttgctaaatgtaaaagtaaaaacctggaagttaatattagctttcactttttggaaaaaaaaatggaattgagccagatacaaattgatagttttgaggaccaactatgtgacaggtgccatgcttagtatgttacatatgttatctcttttaatcctgattggacatgttgccattttaacctaatggaaatgaacttaaaatggtcactgtcatacatagctattaagtgcctgaacagggattaaacccagacttgattaaatgcaaagaccgtaccttgaaaacctgctttggaggcttcttggtgccattgcatgagagaagtaagtcaccaatggcattctggttcttactatattgaaagcgtctttctagtgaacccatattactacttcactgctggcaagactggcagaattctgccttctccttttgagcatccattttgtttaaaatttgcctgaagaccaaaatctcagatgcaaatcagaaagcatatacttctttacaagacggctcagctttctctattcagaagtcttccacttgaatatctcaaatttcaaaaaattcaattcatctaaagtgtattttaattattttaaaattaaaagatttaagtaagcaatccattccctgtcccaggtctgttactagctatgtgactttgtgcaagttgcataacctcttttcgccttattttcctcgtgtataaaatagggattataatgttctctcttacacagggcttgtgtgagaattaaatgagataatgtatgtacaggacctagcaaaatttattctaataaatgccagtgtgcaagggtgaaagggtttaactcacactgtattttgaatgcacaaagaaaattaatttgttttacttcaaccatagctaatctgatcattaccccagcctccatcagttgtttattaaggatgaaaactgagttttattcttctgtgattaagtttaatatgatttaagaagttagatagtccctttaggttgttttcatctttcttgcataaaaattgctagtctctcatgttcctctctccatcccctgctttcctccctaagatggaatttgggtatgtgcagaggaggctaaatttctttgtgacctgggcaataaggactctctggcctcaagctagttttcagaagtaggttggcagcatatgctggtctctgggctgctgtctgcagctgatgctgcgtcctgttaaatcgtcagttctgaatccacagtcaggtctgcgggctcagataaaactctctaggagcattggccatcttcctctttgggcattgctatactcagctctcactggctgtaaatgaatgagactgtgccctgtcctccctccagcacaggatgagcagtccatccccagtttgtgttgtgatgggccctcaccagccatgacctcagtagtggccccatggcctgtctgctggctctgagagtccacataacatacaaactgagagacaccaagtaaagctgaattccagagacttctttgcctgtcagattacactgtcaaatttactctgctttggatatacctagtgttgttacaaagcagtttgcagggtggcctcaacacagatattaaggcaagagtacctcataaatacatagcttaatgcacctcaggaatttttaaaggagatatttattaacgtaggtagagagtttagtgggggtggtaaataacagatagtggcaaaactagtagttttatacttattgttttaaaaataagttgttaaagacctaagatctgcccacacatttattaagacatgtaggtcagcctaataattgaaaaacatggagggtacctttgggtctatagctcactctctaacttcaacttccttatcaatacagtaagggcatcagtcttctctatcttataggctttttgagagaatttcatgcaagataatctacaacaaatattcagtatgttaaatgaatttcaattctgtcaggtatattattctgcaagtgcttcatatgaatatgtgtgaatcggtattttactgtaaagatttgggtcaacaatgatgaaaagggtgggtttatttttcaaaactagttgtactaaaagtaaattttaaattattttaataatgtatgatttatggtatctaagaaatcctacgagcagaaataacttttattttgtgttatgccagtatttcatgccaggcacaaaataagtctctttttctattttcttacttttgcatttgttctaagaggttttatttggtagtgcttaagtatttgaagagtataactgtggaactttacatttctgatgttactcacttttaatcatagtttgactattactagtcatatgcatggaactggctgttgttgtaacagtaacaactttgaatgagaaaataagagattttgctctgataagagacctctagaaacaatgtcatgtggaggagaggagatcaaattctattctgtagctagatattgacaccgtaggagattatcattagatgatttatttttgcatgacatggtaaagagacaatgtggagagtagatgactataattttaaaaataaaatgtgaaggcctaatgagaacagaagttggcttgcttgagaagcaatgtaaatgtcccaaataagattcagagtagaaatatctacttatagaagcatttgtaataatgaaaaattctaaacaaagggaattattttatatttttaatagcaattatccccagaatatattgaacaaagttctgagaacataatagatattttggcggggggggggcggggggtggggggttttgttgtttctttcatgaattgttttgctcaacataagatgaataaatgttcatttttaaaaaaatagaaagttaaaaagtgaaaaaatgagagtaaggatcattcatgatctcatcctatatataaccattattaatattttttggtatattcttccctttactctcattttctttaatgaagtcaaacaagtattatttggggccaggtcagagatggaacactattaggctgatgtatggaaccagataacattaacccttaggatcatcctctttgctgaccatggccaaccctccccctagtctagacccagcttccagctgcaagcctccttcactgcctctctcctcccctccctgtgctggaaaaaagagggctgttctataaaggagagtgtcacttaaggccccaacaactctaccatgggagccttcatcagaagagtcagttataagaagcaaaacgtgcttttttgtaagccagaaagaaagaagagcccagcccagaggagactaacaaactgagtgagaagtagtctatatgtggtttagagttcgggaattcaaagaaagcagcatgggtagggacccactgacccacagtggcaatgggtagcagggaaggaaggcagggagtacaatggttattggagcagcatctccccttatgtgaaattcccttgtctttgcccccaccaaacccctacaaaggactcctaaaaagaataactggggaggactatttcaagaaggacctaatttccttatcctgtgctattcaagcaggtagtgcttgaatagatttaaaattttgctataagtatggcataatacatactggttatatgtgtctgcacagatatttctacctaccaaattggaattataatgtgcattctattttattttaaagcatggttatcaaattcgaaatctagattccttataggcattgtaatatataacctttctttgtagctaaactagaaagactgccaaataatggatacaaaataaacactaaattaagttgtctatccctgatttctaatgagattgatgattttttcatatgtttgtggcaatttgtgtttcctgttttgtgaaatgccggtttatgtatttttgctcatttttctattggtagtcattttcttgttgatttatggagatctttgatatatttcacatactaatcctttgttgtctgtaggtactacaattatttcttttcagtctctggagagtctttttattttctacctggtatattttgatggatagaaggtcttaattataaaataagaaaatgtatagttttttgtgggtagcacattttctgttttgcttaagaagtccttccctcctcaaagccaaaacgtgtttttcatatgttttcttctaaacgtttgaaggtttaattttttcataatcaaattcatttctgtggggggcttaattatttatactgtgtactgtgtattttttttccagagactcagctttccaagcaccatttattaagtagcatttcctttccacatggatatgagtatcacctcttaacaaaatatgatttctgtacattcatgagttactttccttattttctaggtacaaaaactacatgattgtaattagcacaaacaataaattttgacagtggatagggcaagtgtctcaaacttaggcatctggacatttactttttgtatgcatttagaattagttgatcaagtttctcaaaaagaaaaaatgttaggacttgattacaacggcattgaccctataactcaattttttattggaacgataataaagagttgacatttctatcatatcaaacctttttaggcatcaacatgacatacatcttcatttattttctattttaatatctgagttttataattttcttcagaaaaagatttcacacatttttaattaatttgttcctaagtacattatttttaaattgtagttataaatgtacttcttcaaaaattatagtttccagttgcttgttgcaggtttttattttttcttccaaatttatttaaggttcaggtggtgcatgtgcaggtttgttacatggataaattgcatgtcactggggtttggtgtacaaatgatttcatcacccaggtagtgagcgtagtacctgacaggtagtttttcaatcttcaccctcctcctaccctccaccttcaggtaggaccccagtatctattatttcactctttgtgtccctgtgtgctcaatgtttagctcccacttataagtgagagcatgtggtatttggttttctgttcctgcattaatttgcttgagttaatggcctccagctgcatccatgttgttgcaaaggagatgatttagttcttttttaacactgcgtagtataccatggtgaatatgtaccatgttttctttatccagtccaccattgataggcatctagattgatgctatgtcctggctatcatgaaaagttattgcaggttttttttacttatatctagctatctgctaaaccctcttaataaaatgaataatttgtttataaattatttagggatttctatgtaactaatcaaatagcctgtgaataatcacagtttgttttcttgcacctcaatttttaaacactatttctttctcttgctttatgtgtgactagtactatgttgaagtgaagcaactatcattgtctgattcctgattttaatgggaacacctataatgttttgtcattaataattgctttaccattagctttgtatagatattctttatcaggttcataacatcccttcctgcttctagattactaagaaaatttagcatgaacaagtactaaattctatgggctgttttgtctgcatttattgatattccattttttctcttttattctgttaatacaaaatttctaatgtaaaaccacttttgcatttctgaaatacatacatggttcatgatctaatcatgatcatgatcttctatataaactatttggttcattcctgcttggaatttgtaaaaatctgtactcattagtgagatttgtatacattattcttgcatactttatctgtaggttcatattactcatcaattttggaaaattatcagccctgtctctttaaatgtttccttttacctatttgctctgtctcttctgctggaatttggattaaatagaaatatgaatataaaatcataagtgcttaggaatcactagctaattttattaattattttatattttcttcttgaaaaagcagtcaatcagagaagaagaattttaaaatatttctttcatatccttaaagagaggctttcttacctttttacataaaattatacggtattaatttcctcagaacttggagacttgatgatgaggtcattttgagagtgttttcaccttttttttaactacttaatgtactcattactcaccaagatatttctaaattataggctactcaatttctggattaaagaacaaaatatgattttaaaaacaaaacattgaaatgatagcagcaaaaatatttaaagagcaagaaaagttattctatgtgaaaaagaaaacaatatttaattttttaaacacagtgtaaagttggattgaatttaaaagttcaaaaattcagcaggaaataagtagtgtcattttaactaacatttgaaacagtaaatcaagcagtcgttataaaaacatttcataaattcagccatccacaaactatattagaagacttgtattctataaaactgctttatagaaaagctttaaaaaaattctgcactctacaaatcaccattttaaatgcttagtaaggctacagattataataagggagaattgttaatctcaatattcaaatggaatttgtttctgttggctttactcactttatttcatagagtcaaacaaaaatttcaaagaaatgaattaaagaaaaattcctagaatagagatattctgagcgatacagttgacaagaaatagatgctttgggctaaataaatgatatgaatgtgttttcatagaaatttgagacagtcgagtacttatgctaatgttttcattataactaaaattgactagaattaaattaaactcattttactaaaagcatggcagccaatagtctcacctccctagttcaccaaaggtgtgctcatttttaattacctaaaatgcatgtatacctgaggcaagcactatatttacatagccagtaatttccttataagcaattacagcataggtttgccacacctactaatcaaattgtataatttattcttcaagttgtacacactttttaaaaagagcaaaataatgaagtacaatttgtcatcacataactggccacccaattttaaggaaaatacttgaaacatgctaatttactccttcatttttctgcatttgtaaagccactaaggctgtagattatatatatatatatatatctatatatatatatatctatatatatctatatctatctcacagacattgccagaagttattaatacatcaaaagaaacttgaaaaatgaaacttatttttgaagttattgggagtatgtcaatttctgtatcaatgagagtccagtcagcaggtgaaaactatactgattatttaacaaagaaagtttaatagaaagatggtttatcgtgtatgagagaactgaaggagcaaaggggggacactgaaaaaggaagtttgaaaaggtgaaattgggtcttcgacttctaaggaggggcccccacaggctagtgctggtgtctctgacatgaagaggctgattctagttatgtggaaaaactacacactggaaacacttgctgttactgaattctagtgtcaccacagtgaagtattgctgaggaagtgcaaagagaagccaaacgtaaataaaaagagcaagtccctcttcctcctccagcccctccccaggacactcaattgttagagcctaacatggagccacttgtcaaaatggcagtgtggctaaccccagaattacaaagtagaaattagaagagttagctcacagctgaaaagctactgtttaataaccagcaagtcggtactgtgtcctgaaaacaatggacaagagaagtgttgatttttgtgactccattttgacgtcattttctccagaaagttttccttgcacctagcagagtacccagctcccaactggtacttgacgtttgtagaacaaatcatttgattttaaaagcaaacagatcgatcaattctcatcatcagaatcatgcctatataaatacaaatttttaactctaaacaatagtagaggtagagaaaatactttaatttgtctgaaaagcaatcattccatagttagctgtcttttgaagcatcaatcccaatttactttgagacatacttccaaatgagtttcttgatgaaactttaaagtacaaaatttgagattgtgaccaataaatacatacgcacaggcaaatatgcatatgtacataaataaataaatctgcagtcccactaactctgaagtttgaaaggaattcttgaagaatcattcaattaaaatgaactttctggctgaaactaattacagagatacttctttcagaggaggatcaaattggggtctccacttttatcaatgcaacatctcttgacctatggctttaataagcagactccactgtcatacattgaagtaaaggaactccttttcttgctcttgaattttccctttgctagcagtaaaataaatcatctttgcttctgttttccaaggaagcagcttttccctcgttgccgtttctcattaacaaaatatcatgactgggcactatgaatgaaattaattagctcggtttgcgtttccataaatggatttttctgagaacggcatgtatctccatgcagtcaaataccctggtgattctgtcaacggtttctaccagagaaattgaagggggaataatgtgtaaattaattaaaagctccctgatggaaccagagtaaagcatattaaataggagttcaaatgtgtaatcaagactttacaaagaatctccccctgcaaaaataaaaaaaatcagactttacaaggaaaataaaagtattctgcaagcaaggagtaaaccctatatatgatacctattcacagctcgaaaacatacttgagttatgaataggagttgtaaatcaccccaaaaaaacaagaaaaattatatttaaagtaattcaaactaaaatcttcatttatatgctgaaatggaaatatctggatgtattgcctaaaatcgaattaatagaaaacaaatgttatttgatttcaggtttcacaacaaaccaaaactaaaagtaaaaacactgaggagaaatataaagaaaggaaaagatgatatggggtggggagatgtcattggttagtctggctgggtaagcttcagtctcagaaggtagcattttagtaaaaactgaaaggaggtcagggagtgagccatgcaaatatctggctggaagattgttctatgcagcgggaacagcaagtaccaacacctgatatgagaccaagcctgacctgtggacagcaagaagcccagaaggacgcagtagaccaaatgagaaaagtattgggagataagttaatttgtggagtgggagagaaccctgtaagacattttaaggatttaggattttattctgagtaaaatgggaagctctttggaagggtttgagcaagtagaacctcgatctaactcacatcaaattatgttactttatattacattaggtcatattaattaattacattatcaagaccactttactatgttgagaatagacgggtcaggcagtgtcaaggtagagtcagggaaaacagttagaaagttattgcagtaatctaggcaggaaatattagcatgctggattagggtagtagcaatggaggtggtaagaaaccaatttctgggtaaatctttaaactatagctagaagaagatatggtaggatctgaattttgtaaattgaggacacctatcaaaaactaatacaaaattagaaatacataattagatacaaaaaagaatgttattcagaataaaaaaaagaaactacaaattttaaattacaaataaaaatcataaaatataattttgaaagctgacaaaatgccacaaacatcataaaatcgtggaaaataacataatagcacacatctataatgcttccttcccccttacattttggtttcatgctctttgacagcctttccatgtgacaaacatcgtgtagtattttctttggagattatagaaaaacaatccagtctttcctctaacatgatttttaatattgatagtttggaaatgcttacaattttcattgatatgccttgcagaattttaggactgttgtcaaatttgggaaaacatttgcctccatacattctaaaccttctttttcctccaccacctacgtacttatagtgccaggaaccaaagaacaggtttatgtctcaatacatgctctggccctgcaccttcatgtcctgatggtcaggtgagtgggcacagtgggcagtaggaggatttccagaagccatttctaaataaaatggctagctagcacaagttaagtacacacagaaattattgcaaatcatataaacacattccacaaaacccgtatgaagggtatccccatacaacttcctttaagcaagctctgcaaaatgcctgggtccattcaatcaccataggacgtgatagaaattgcaacagaggggaagcaaaatagaaattctagttaaaatatcttacttttatccagaattccaggcctacatatatacctgtgttacttttctatttctgaatggtaacaaattaccacaaattcagtgaataaaggcaatacaaaattattatcttacagttctgggaggtcagaagtcctaaaatccaggtctcatcagggctgcactccttctaaaggcactagaggagaatccatttcttctcttttcccagcttctagaggccacttgcattccttacgtggccccttcctcacatcgccttgatctctgcctctctcatcacattttctctaccatctctgacccccttgcctctctcttataatgacatttgtaattacactgggccccctcagataatccaggataatctctccatctcaagatccctaaattaatcacatctgtaatttcttttactatgtaaggtaacatatttataggttcttggaattaggatgtgaacatctttggggtgtcattattcagtctactacaagtttgtgcagcccttggcctatgagccaccatgtagcccaggacggctttgaatgcagaccaacacaaatttgtaaactatcttaaagcattatgagtttttttgcgattttttttagcttatcagctatcattagtgttagtatatttttatatgtggcccaagacaattgtttttcttccaatgtggcccagggaagccagaagattggacagccctagtctactacaatacccaagaaaattgaaaatgctatgttcacacaaaactcatacatgaatatgcaaaccaacattattgataataggcaagaagtggaaacaatagaaatgtccatcacctgttgaatggatgtgcatgatgtggtatatccatacaatggaatagtattcagcaacgaaaaaaaatgattaaaggtccgatatgtgctacaacgtggttaaaccttgaaaacattatgccaactaaaagaagccagaaacaaaaggccatgtgttatatgattttacttatatgaaatgtctaaaatagacaaatccacaatgacaaacagtagattggtgctttccagggtccagagggagaggagaatgggtatgggttttttgagaaatgatgaaaatatactggaattagatagtggtgatggttgacaattctgtgaatatactaaaaaccacttaattttatactctaaaagggtgaattttatgacatatgagttatatttcaatgttttaaatcttataaaataaaacaatcttacttttgcaaatattccaaaaacatatggcccaagtgaacacttttccaggctgcctcccaggatctagaaaggaattcatgcaaatagggctttaaagcttaagcttcattaacttcaaggtaaacctgcctctaggtagaagcaacaggatttgttgacagatcagatatcaggaataagagggagagtagttaagtgtaacttcaagatttgagacctaagcaacttaaaaaatgaaatttctagttccaaataggaaacaataaaaaatgaaagttttttttttcagttcttattttttatcatggtaaacacacacacacacacacacacacacacacacacacacaacatgagatttaccctcttctcaaatttttcaatagccatttcattattgtgaactactaagcacaatgttgtgcagcagatctctagaacttttctatcttccataactgaaaacttttgcccattgaactgcaactccccattttcctctccccagcccctggaaccaccattctgctttctgcttctatgggtttgactttttcagatatgtcgtttcagcagaatcatgcagtatttacctttctgtgactggcttatttcacttaccaaaatatctccaaggttcatccatgtttctacatgataggaatttcttctttcttgaggccaaatcatatttcattacatatatatgctactcatcagttgatccactcattcatcaatggacatgtaagacatttatttattcatccatcagtggacatttgggtcacttatacatcccagctatcgttaataatgctgcagtgaatacataaggacaaattttttgaagtccctatttcagttcttttggataagtatccaaaagcatgattgctggatcatatagtagttttatttttaattttttgaagaaacttcatattgttttccataatgacagcaccattttacgttcccaccaacagtacataagagttccaatttcccccacatccttgccaacacttattattttggtttttttttcttgataatgttcgttataacaactgtgaggtgatttctcattgtggttttgatttgcattttcctgattattactgatgttgagcattttttcttatacctgtgggttatttgtatgtctttttttaagaaatgactcttaaggttcctttctgttttttaaccaggttgttttactattattgagtctttttaattcctcatatattttagatattgatcccttatcagatatgtagtttgcaaatactttctcccattccatatgttgtctcttcactctgttgattgtttcctttgacttgcagaagatttagtttgctgtaatcccacttgtctatttttacttcttttgtctctgcttttgggttatatccaaagagtctttgccaagaacaacgccaagaaacttttttctgtattttcttctagaagttttacagtttcgggacgtacattacttaagtcttcaacccattttgagttgatttttgcatatggggtggaataatggtccaatttcatacttcagcatatccaactttcccaaaagtatttatcagagactatcctttccccattgtggtgctgttgacacctttattgaagatcagttcattagtataaatgtggttttatttctgggctctctgttttatttcattggtctatgtgtctgttctctgtgcctgtaccatgctgtttcaattaccataactttttagtagattttgagatcagatagtatgatgcctctagctttgttctttttgctcaagattgctttgtctatttgtgaacttttgtgatttcatgcttgttttagaatcattttttataattctgtggaaaatgttagaatttgtatggggattgcattaaatatgtagatcactttgggtagtatgggcattataccaatattaattcttcccatccatgaatataggatatctttccacttatttctatcttcttcaatttatttcatcaacattttatagttttcagtgtacacatctttcacctctttggttaaatttatccctaagtattttttatgctatgataaatgggattttcctgatttatttttggacagctcatttttctgtataaaaactctattaattttatgttgattttgtatcccacaactttactgaatttgtttattagttctaattttagtggaacctttggggctttccatatacaagagcatgtcatctgtaagcagagacattttacatctcttttctatttgcatgcctatttctttttcttgcctaatttctatggctaggatttccggtactctgttgaacaaaactggtaacagtgtgcattcttgtcttgttcctgatgttagaagaaaaggttatagtttttcagtgtcgagcatgatgttagctgtgggcttgtcgtgcatgacctttagcatgttggggtacattttttctatacttaatttgttaagagtttttatcatgaaaaggtgttgaattttgtcaaatactttttctgcatctaataagatgatcagattatttttatccttcattctgttaatgtggtgcatttcaaatattgatttgcacatgttgaaccatccctttattccagagataaatcccacttacaaatgttctgtgtgcacttgagaaaaatgtttattaagctgtcgttgggtggaatattctgtacatgtctgttaagtccattggtatacagggtttatcaagtcctgttttttgggtattttttttattgatctggaatgttctagccattgttgaaagtagaatattgaagtcccttactcatattgtgttgctttctatttcctccatcaattctgtcaacatttgcatcatatatttagatattctgatatcgggtttgcatatatttatagttgttatagcttcttggtgaatgaacccctttatcattatataatgttctttatttattttgacagtttttaaagtctaatttgtccgatataaatattaccagtcttgatgtcttctcattaccatttgcatggaatatcttttttcatccattcactttcatcctatgtatgcctttaaagtgagtaggccaggcgcagtggctcatgcctgtaatctcagcactttgggaggctgagatgggtggatcacctgaggttgggagttcaagaccagcctggccaacatggtgaaaccccatttctactaaaactacaaaacttagccactcgtggtggtgcacacctgtaatcccagctaatctggaggctgaggcatgagaatcacttgaaccagggaagcagaggttgcagtgagctgagatcgcaccactgcactccagctgaggcaagatcatgccactgcacttcaccctgagcaacagagtgagactgtgtctcaaaataaataaataaataaataaataaataaataaataaataaatctaaagtgaatctcttgtagacagcttatagttgggtcttgttatatatctattcagtaacactgtgttgtctcattggagagttcagttcatttacatttagagtaattactgatggagaaggacttagtattgccattttgttaagtattttatccctgtcttataacttttttgtgttatttttcttctctttctgttttcctttgtgtttcattcattctttatagttatttgttttgactcctatttcattttcttttgtgtatcatcaataggtatattttgggcttaccataaggtgcttataaaatatattatagttataacaatttattttaagctgataacaacttaacttcaatcatatacaaaaactctacacttttacatttccccaagtccacttcatgcttttgatgtcacagctcatatatttttatattatatatctatcaacttatttttatagttatatttatatactgttgccttttcatttctgtaccaggcttaacaatggtttatgcactactacaatattccccctttatctgcagaggatatgcttcaaaacccacaacagatgcctgaaactgtggatagtaccaaacctatatatactattttttttacatatacatacctatgataaagtttaatttataaattaggcacaataaaagactaacagcaataactaataataaaatagaacaattataacaatatactgtaaaaaaaagttatgcaaatgtgatctctctctctctccccctctttctctctctcaaaatatcttattgtggtatactaactcttcttgtgatctgtcaacctgataactgagaaggttactaggtgactaatcaggtgggtagtgggtacagcatgaatacgttggacgaaggggtgactcacatcccaggagagacagagcaggacagtgcgagatttcatcctgctactcagaacagtgcacaatttaaaacttataaatagtttgtttctggaattttccatttaatattttcagattatggttgaacactggtaactaaaactatggaaaatgaaactgtggataagcaggagattattacagaatgacatactatgtatttgttgatatgtttacctttaacagtaagctttatactttcatatgcttttgtgtcactgtttactgtccttttgtttcaacttgaaggactctctatagcatttcttgtaaggcaagtctagtggtaaactccctcagctgaaccactccaactgtaaagtaattatattttacacaattctatttcctccagtggattttcccctaccccagtcttcctaggcactcaagcagagtgctacatattgtctatggtgagtgagcaagcagatttacaaacaagcacatatcatttgggtccttcaagaaatgtgggtggcagtagggggcccttctttatatgaccaattcccaatttatagcttcctctgcacgactgaataatcaatgttgtgattgatgtgccagctacttttacgaggcactctagctgagttccaaatgaagagagctccccaacccaccatctcctccagccattgatataggattcttaaggcctaaagctttacttgacagcaagacgtggatgaagaattactgatgaggacaagcacattacagactttcagtgctgtttcgattgtgccaacctgaagttaggtagaacactgcctccttctatatctgactctattactcatattagaagtcagtgggagcagacatttaatgagaattttcagctagtgagataactctaagtactaagccgtaactgtctagaaatctttcagtctctccttatggactaactatggcctgttttgctctcagcccctgctgtttcaagtctggagattttgtttaaattgttaagctgattatattgctctttagttacaaaagtagttgtaataaagaaaaaaaaaaaaggaaaaagaatgttcccctcaccaatctcccagtcccaccccccagaggtaggcacagtttaatgtctaccatgccacttctttctctatgcatttacatttacatgtatgtgcatctttttcacttaaagatatattaggctgggcacagtggctcacacgggtaatcccaacactttaggaggcctaggcaggcagatcacctgagcccaggagtttgtgaccagtctgaccaacatggcgaaatcctgtctcgactaaaaatacaaaaaattagctggctgtggtcccagctactccagggactgaggtgggaggatcacttggccctgggaggcagaggttgcagtaagtggagattgcgtggctccactgcagtctgggtgatagagcaagacccagtcccaaagaaaaatagagagagagagagaatataaatattgtacatcttttattagttttattcttttatttaatctataacctattgatgggcatctttgttgtttccaatattttggtattttaacaatgccataaacaactttttatatatacatgcatatacttgcaaagaatggattcttacaggtagaactactggatcattggatgtgcatattttactttaatagatagtaaatttttccttccaaaagcattactaatttatataaacttttggtactcattaaaaaagccaagcaattctgacatcccagagggactcgttttggtttgtgttatcacaggcgattgacactgatttttttaatcgaattgaatctacttcgtgtcttctacaaaattctatgcatttatggcctctttattttttttccttttctgtccactagcagcagcattttttttctttcacttgttttcagtgaaagaaaatctgaatcagcttactctttttccattcaccacatgtttactctatgtttatgtagctattctcaacaattgagaatacaaaacttaatgaaacacaaattttgccattcagaaatccaagcctaataatagtaatgaaaatgaaagtaccacagttaatagacagatagacatatggatggatggatggatggatagatgataatataggaaaactgaagagtgacttttggagggaaaggcagagaggtccagggtaaagaaataattgaaaggtaaatacggaagagataacaactcatagacatgaggagtgatgacagaagacaaggcttggaaagcttgaagaaattatataggctggagttacagatcattttgtagaataaagggaggcaagagtagaaaattaaactgaaataagactaccagagtctttgaatgccatgctaataatttagtatttatcctatgaatgacaaatagtctcaaaaattataagcaggtaaataatatattagggcctacattttaaaatttgctctgacatgaaagatgagttaatcaacatttttattgtaaactaagtgttagaagttgtggtaagtgctaaaattttaatagaaacagacggaaaccaatgataattgaaaattattataatagtttcagaaatatgatacagccagaactaaggtggaaacagaggaggaaaagaatagaatgaaaaaataaagaactgaaagaacacaagggagatggataaaagagagaaataatctgctatgttgcttttagttgtaatctggatgctttgggcataatgttagaattgaaataagaatataggaggagaaggaaattgagtaggaaaagatgaaacagttctgaacacactgagtttgaattgcctttggaacacacaggtggaaatgtctaaataatagagagtaaacaaacacagagaatgggagaaatattttcaaactatgcatctgacaaaggtctaatatccagcatctataaggaacttaaacaaatttacaaaaaaaaaaaccattaaaaagagaacaaaggacatgaacgtacttttcaaaagaagacatacatgcggccaacaaacatatgaaaaaaaaacccgcaatatcactgatcactagagaaatcaaatcaaaaccaccctgagataccatctcacatcagtcagtatggctgttactaaaaagtcaaaaaataacaagatactggcgaagttgcagaaaaaagggaacacttatacactgttggtgatactgtaaattagttcaaccactgtggaaagcagtatcacaagtcctcaaagaggtaaaagcagaactaccattcaatccagcaatcccactactgcttgtatacccagaggaatataaatcattctgccatgaagccacatgcatgcaaatgttcattgcagcgcagttcacaatagcaaaggcatggaatcaacctaaatgcccatccatgacacactggataaataaaatgtagtacatatagaccatggaaaactacgcatccataaaaaagaacaagatcatgtctttcacaggaacatggatagagctagaggctattatccttagcaaactaatgcaggaacagaaaaccaaataccgcatgttctcacttaaaagtgggagctaaataatgagaacttatgaacacagagaaggaaacaacaaacactggggtctacgtgaggatggagggtgggagaagggagaacagaaaagataactgttgggtaccaggctgaatacctgggtgaagaaataatctgtacaacaaaccctcatgacatgaatttaccttcaagtgtaccccctaacctaaaataaaagtttaaaacataaattaataataataaataaaagatagttagaaatatagatttgaaacttagtaaatgtgactgagctagataaatatttgagaatcactgatgaaattgaccctatgaaaatggataaaaacagaaaataaaatgtacagaatcagaagaaaaaggggttctggaaaataacataacaaatacataaaagttttacaaagtttaagatgttatataatataactaattattatcactgtttctgaacaattgaaccaaactactagatctaatttaacttccacaaaatcaaggaatttgtccccctggttcaccagtatattctagaacttatagaatattgtcaaacatatgatatgtttttagtaaatatttattccttgcccaaatgcatttattgaatgccttagacatatgtatttattatatgggtggattaggagtcatgacatttccccatgagagttctaacaattctcttccacagccacactgttgaatttgtaaagccagatcgttaactctgaaaaaaaagtcttccttaaatttatagcccaattaatactacagaaatcggtcattacttaaatgttcaaacagttggctttgcagggtaattattattttttccattccaagtacacatttttgtcttatgttaataagacaaatacaaatttaagaaaatgtttacagttaatgtggagaaaatgaaaaagaagcatacatctatagtaagattcccaatgaactagaactgcattcttcatgttcaggcacctccagtgtcttcacagcatgactagaatattgttaacagtgacaatcttctagttagtgccaacaaaatagagaaaaccctagtggtgcgtggtcctcctacatgctgtgggagccctcctttggagaacaaaacaacctccattaatcagtcaacagaaattttttgaactcctactgtttgccaggcattgcactacattccagagggcttataaagaaatgtgaagcctgcccatgccttcaggaaaagtatgtttgtaggagagacaaggcaaaaaaaaaaaaaaaaaaaaaagtatatattgtcaaatgagttgtcaaaggaataaatgctattctgtggtgtagtattcaaggtctcctaagatctggcccagtttacctttctggagtgtttccttaaatccaccgctacaaggacaattgttcttctcgtagtctttactaacctaaattgaactgcttgctgtccttcgtatgtgcagcatgcttcctacctctgtgttcttgcttttactaattcttccttctggaatattcttgcttttcttatcagcaactctatgctatagtttgtaaatcttatcttttcctcaaggaacaactcaaatacagcactttctccaaaattccttgactttactagctataaataatcttcccctcctctaaactcctctacaaagagatctgtactgcacccattatttttgccttatgtcttagttgtccctatttatggaggtgcataatcatggcacacatctttcccttctccctcctctactgtttggtgaatagtgcctataacagattctaacctttgggaacccactgtggtttcagtgcatcaagtgctgttgactctttccatttcctgttttccctgaaaccatctcacaggccttttcatttttttacatgtaataattacataatatatctgtattgggattaaccaactgcactaactaggatgggagcttcttgaggagctccttgaagagcactcatcttagtgactcctgtgtccacacagtgtatgttaaagaagcatccgcagattaccatcaacacttgttacagatttttatttctaggccacacttgtagaaattctgtttcagtgagtttggtgcagagctcaggaacctgtattttatcaaattctctagatgattcttatctgataaatttgaaaatagtcaccagttaataagtatagaatttgttgaataaatgcttacttttttctctctctcttaaactataagcatcttaaaggaaggacatgtgtttctaccaggtacctggcccagccatttgaacatagtagtttctcaaacactgtggaattggtctacgttaatggggtgacttatgactggggtaatgaagataagctttccgtaaggcgcagaattttttgagccttgaaaaatgagttggatttggataggtggggaggggagagagcatcctggtcaggagattgacataatcaaaggaaaagggtagaggaaacacaagcgtgctgtgggttgatgattaaattagtttaacaagagcaagagattcttgtggcagaggaatgaaagatgaggctgcctccccactgtataaaataaacatttgttagcagagctctcatttttgtttcaatttaataaaagcaaaaataagtgattttgatgtgattaatgaccaataaggggtccacagtgctgacttggcgagcatccaccttcatggcacatgtagaaacacaagatttagtatagaattaacttgcccaagcatctgttcacaaatccatatgaaaaagaaaaaatagaccaaagcatatgttataagctaaagtctcaacaacttctttttcatatcatgttgataggaattcacatttttagcaaaatctcttactgactgggtaatgtgaattcaaatataagataaccacaataattataaagaaaaactgtttttttaagaaaagcattctgttcacacatgaagaaaatattagcttgttacaaaaaggacaataaatttgtagttaaaatatattccttctgtcttatgacattgtcagcaccaacctatacatttataattaattcacttgggcatttactcattcactgatctgataaatagttattagcaatctactgcttgcaaagctatacacaagatgttaatggcaaagcactatgtgcatgatacaaattgaagatcattcttacatggaagagagaagaaagattgattagaataattaggatcaaattattattcatttcttcgttcattcaacaactcttagatgaatgaatacagcccatgactttgctttgttctctgttatatgccacacacagagcatagcacttgatatataagtgctcaataaatatttgttggatgaatacttgtgttgatcactttttcaggttctcaatatacaaaagtaaagtaaaaacagagatgtccttgccctcagtgagttcatagtctagtgaggaagacaaatattaatcatgtgcactcaggaatgtaaaatttcagctatgccaagtgttgaggagcctctatcagatttggcctaacatacaaagacttcctgaagaaatgatattgcaatgaaatctaaagaacaagtggaaattaaccaggctaagaaaaggaggaggagtgctttaggcagaagaggcagcaggaaagagcataatgagtccactgtggctgccatgcagattgagaggaagtcacaaaaatgggaatggaaaggcaggtggctagggtgaaagtgtgtaaagacaactcttcgggacttcaagtttataaatattgggcaagattatatagataaggaaatatattgtttaaagttaataaaatccaaatcaggttgataaaattggtatgtttgcaacagacatttggttaaaattaaaacctcaaaactcattgctcatctgtaatataaacgaaaaatttgtgtgatgaatccaagcaattttttttcagtgacaagcaaaacaattgagcatgtaattccaaattacataaccttggcccttgtacattgagccaataaatattataattttactaaattacacagcagcaattagccctcaaatgagggttaataacaaaatcaacacagtatcataaaaataatttgggtgtactgatgtagaactatattgacaaattaatataccctgacaaacaattcattcaacttttgtgtaagactaataaaaaatacctaatttattgatgtagttcacatggtagaatttatgcagagaaaagtaaagctgagactcttaaagagcagttgtggaatgtggaaacaatgacattaaaatatgaccaaagaagtagctgactttactccctcagtagttattataaagtatttggtcaggtagactaatattattttacacaatttctttagtttttcctcttgcctgtatcctagtataatttttaccacagtatttaactctggatatatatctctgtccattaacctatatcaacattttgtctgagataatattatagtaatattgagtttccctcttctccacacccacactcatatatcccataacacagagctgcatatgggattggtgcttggtaagtacttgttaaattttcaggagtggacaattagaatacttgtgaataaatattacaagttttaacagtaataatgagaagtattttaagttctgagtaagttaacttattaatgttattattatttgagtagtcaggttggggatagatgttgaagaatgttataaattaattgtcccttaccagtttatattatttatgtaggatatggaaaataaatatattaaatatccagcaatagttacatcatttctattctaacctgatacctaattgaaaataagtataaaactgaagaataaaaattagaatgtattgtaaaaataggatataacatattcagggtaataaaactaactgtaatatatttaagaataataaaataaaacaaatatgaaaaatgaataactcattttccacttaaaataatccatcgaactctaatagtgtttaaaaattttgcattttttcaaaatgcagtttaaaagcccatgatgtataacacacgagattttattgctctacgtaacattactatgcagtgaagtcaagtaggataagtataagcattcttacttctctaatgggtaaattgaagcacagcaaaattaaaggtttctactgatgacactaatcttcttttttcatttaacatatatttattaaacattcacttttttcatttaacatatatttattaaacatttaacatatatttattaaacattcatttaacatatatttattaaatatccactaggtagaggccaggtgatgactcagtttagcattttatatctaccacaaatggaagacaggataactttggaactgatacatgaatgaatttttattatgacttggttcttgcctgcctctaatgaagtatttttctaccaaacacacaaccaaatggtctttacctggaaagacttacaatttttttaatatagattcttacttccattgaacaaacgtaaggtactgacataaaaagcagactatctaccttaacgtttactgactttgaggcagaaaagataatgcatgtacacttgacagcttaacttctcatttgatgaaatgctcactatttaacagattggtgatataatttttttgttattttctgttcaggtaattgggtattatgtagtttagtagagagtgaatgctcctatactagatattgattaccaactttcaaagaattcaaattttgaattacattgaaatcatgctgaacagaagtagtcttttctgattcagaaggtatttcagttttgcagtacatctttatgacccgaatgttattgccaacattttttgcaacagtcacactgctgagtaccagagattcagagatgcaagttctactttaaaagctcacaatagttatagaattatcagtaaaaagaaatttcaggttactggtttgccaataaaaaataatgaccttatttgttttccactcagtgaactatctaaattggaaaaattatttatctactctagaaatgaaacatttttggatattttcagaggttagctcataggaatgcataataatagaatgtgatgcaagtaaaaacatgtattttcaacatttcaaatattaatgagaaaaaacagatatactgtagaaactatataatttactataattataatttatgttaatgaacacctatatatcatctaatgattctaaaatgaaatattgcattggcaacttcaaattttctctatatcttaaaaatatttgcagccataaaatttcttttaatcaattggactttaatgtaagttttgcatttagacatttaaaattgttttttcctctctaatttgctatctgccctttattggctgactttactagctaagtacttagtctgacttatgtagctgtatttcagggatcctagctccaaaatggaggtcataaagacttccacaagagcaattttcagtgccctatcagagtgggttgaagtgtgaatgggagataaggaagcaaaggcaaagagttgggcacattatttctactgtgatcctgtgagaaacagagcaaacaaatagggaagtagatggaaggatctgtagcatctataaaaatggtatctttttaatcatggaagaaaccaaggcatgtttgtgtgctgctgaaggtgacctagtagagacagaggttgaaagtgtataggaaataagtccagatctagagttcctgtaaagacaagaagagatttagatctcagatggacaggaaggaaacacaaatttgggagagccagaggtagttaatgggagaaaactactgaagtgaccgcaaaacacataaatgtattgcactaaattcagactaattgtatccccaattcaacttcaactaagccagatcctaaatatgccacattttgtcagaggaagtatgatgaagagaaagtgaacatagcaaaatacagcagtcttaaccaattgtcttaaaatatattcctttgcaaattctctaactatgcatgtgaggaggctgaagcccaagctttattacctttggagtaaatctatctattattgtttgtgtttgtttcagtaaataatagggtaagtgatgagctgtggtaaaaagaggacagttttgacaagattgaagagttatgaaagagtctcagagagttgaaaagcaagatgaggaaaagtagcaaagttgcaagcattattcaatccctatttcaggtatttgtctggaatttaaagttaaagcagtcagccaaactgtgattttctccaacaaatcttcgggcatttgcagaaaaggcagaatgttggattcaaccaatgttaagttcaactagggaaatgtaacaaaagaaacagtttgctaagtgatgtttgcaagaaattgttcataacgatgaactgttaatgaatctcagcttaggaaggaaggaaagataggtaaatagagacaaggtaaatttagcctatcagtgatatatcaataactgtggcagaggaattctaggatactgtaataagtgaactgaaagtataggaggtgatgatcagccagtggtatatttgcaattgagatttcaaaggtaatatagatcattgtgatgacaaatctaagtgttatctttggaataagttactgaggtggagaagaacagattggttatgaacatagatcgtttattttgttcaatttagatggaattcttggagcagtagcatgcacaagttaccttggaaggaactggagccacagagatgaacaagattcagtcctctgcttcaaggagctcagtatatatatgcaaagtgctacagtagggatactaacacagaaggaaggatacctaacccaatcagggatcaggtgaacggtcttagaaaacaacatttgtgtatgttgaaccaaccttgtatcctggggatgaaggctacttgattgtggtggacaagctttttgatgtgctgctggattcagtttgtcagtattttgttgaggatttttgcattgatattcgtcaaggatattggcctgaagtttttgttgttgttgttctctgccaggttttggtatcaggataatgctggcctcatagaatgagttaaggaggagtccctcctttttgattttttggaatagttttggtagaaatgatgccagctcttctttgtacatgtggtagaattcagctgtgaatccgtctggtcctgggttttgggggttggaggctatttattactgtctcaatttcagaactcattattggtctgttcaggacttcaatttcttcctggttcagtcttgggggatggtgtatgagtccaggaagttatccatttcttgtagatttctagtttatgtgcttagagatgtttataatttctgatggttgtttgtatttctgtggggccagtggtaatacccccccttataattttttattgtgcctatttgattctttgctcttttcttctttattattgtagctagagagctatctgttttattaagtttttcaaaaagctagctcctggattcgttgatcttccaaatggtttgtcccttctctatctccttcagtttgactctgattttcgttatttcttctgctagctttgggatttgtttgctcttggttatctagttcttttagttctgatgttgggttgttaaattgaaatctttctagttttttttttttatgtgagcattcagtgctataaattacccttttaacattgctttggctgtgtcccagagtttctggtatgcgaatcaataaatgtgattcatcacataaacagaactaaagacaaaaaccatatgattatctcaatcaatgcagaaaaggccttcaataaaattcaacatctctttatgttaaaaaaaaactctcaataaactaggtgttcaaggaacatacctcaaaataataagagccatatatggcaaaaccacagccaatatcatactgaaggggcaaaagctggaagcattccccttgaaaactagcaaaagacaagaataccctctctcaccactcctattcaacatagtattggaatttctggctggggcaatcaggcaagagaaagaaataaagggcattcaaataggaggggaggaagtcaaactatccctgtttgcagatgacatgatcctatatctagaaaactccattgtctcagcccaaaaacttcttaagctgataagcaacttcagcaaagtctcaggatataaaatcaatatgcaaaaatcactagctcctctatacactagcaatagtcaagctgagagtcaaattacaaatgagctcccattcacaattgaaataaaaagaataaaatacctaggaatacagctaacaagggaagtgaatgatctctacaaggagagctacaaaccactgctccaagaaatcagacatgaaacaaacaaatggaaaaacattccatgctcatgaataagaagaatcaatatcactaaaatggccacactgcccaaagcaatttatagattcaatgctcttcccattaaactaccattgacattcttcgcagaactagaaaaaactattttaaattcatatggaacaaaaaaagagcccaaatagccaaggccaaactgggcagaaagaacaaagctggaggcatcatgctacctgaccttaaactatgctacagggctgctacagtaaccaaaacagcatggtactagtacaagagcagaaacacagaccaatggaacagaacagaaaacccagaaataagactgcacaccttcaattatctgatcttcaacaaacctgacaaaaacaagcaatgggaaaaggattccctgtttaataaatggtgctgggataactggctagccatatgcagaaagttgaagctggaacccttccttataccatatacaaaaatcaactcaagatggattaaagacttaaatgtaaaacccaaaaccattaaaaccctagaagaaaacctaggctacagtaccattcaggacataggcatgggcaaagatttcatgactaagatgccacaaccagttgcaaaaaaaagcaaaaattaacaaatgggatctaattaaactaaagagcttctgcacagcaaaagaaactatcaacagagtaaacagacaatctacagaatgggagaaaaattttgcaaactatgcatccgacaaaagtctaatatccagcatctataaggaattaaaatttaccaagaaaaaaaaacatttaaaagtgggcaaaggacacgaacagacactgctcaaaagaagacatacatgcacccaacaattacatgaataaaaagctcaacatcactgattattaaagaaatgcaaatcaaaaccacaatgcagtaccactccacaccagtcagaatggctattatttaaaagtcaaaaaacaacagattctggtgagattgtggagaaaaaggatcacttatacactgtgggtggaagtgtaaattagttcaaccattgtggaagatagtgtgagaattcctcaaagacctaaagaaagaactaagatttgacccagcaatcccattactgggtatatacccaaaggaatataaatttttctgttataaagatggatacacacgtatgttcattgcagcactgttcacaatatcaaagacatggtatcaacctatattcccatcaatgacagattaaagaaaatgtagtacatatacaccaaggaatactatgcagccataaaaaagagcaagatcatctctttgcaggaacatggatggagctggaggccattatccttaacaaactaacacaggaacagaaaaccaaataccacatattctcacttataagtgggagctaaaaatgagaacacatggacagatagggggaacaacacccactggggcctactggaggacagagggtgggaggcgggagagaatcaggaaaaacgactaacggatgctaagcttaatacttaggtaatgaaataatctgtacaacaagtgctcatgacacatatttacctgtgtaacaatcctgcacatcctgcacatgtaccccgaacttaaaataaaagtttttaaaaaaaaacaagaagaagaagaacaagggtcaggcgcggtggctcctgcctgtaatcccagcacttcgggaggctgaaggtgggcggatcaccaggtcaggagtttgagaccagcctggccagcctggtgaaagcctgtctctactaaaaatacaaaaaattagccgggcatggtggtacatgcctgtaatcccagctacttgggaggctgagtcaggagaattgcttgaacccaggaggcagaggttgcagtgagctgagatctgggccactgtactccagcctgggtgacagagcaagacaccgtctcaaaaaaaaaaaaaagaaagaaagaaacaaagaaaaagaaaacatttgcaaagaccagattgcaagatcaagcatgatgcctttatgaactgcagacagttgagttttccttcaggctggagggaacagtgaaaggagagcccaagaagtaagcaagggtcaaataagagactttttgtatgatatggcaaaggcctagtgggggctttgtattctttggataatgggaagactgcttcaagcaggagtaattatactgaaatggcccacaggctacagtgtagatagaagatggaggaaggtagtagccacagttttttgtgttttttttggagaaagaatataagacaagtttgaattataaaatgagagtgcatgggttacatggtctttactcttaaatttagattcagacgaagtcaccaaagtttgcggtataggtggagggtaatgcattaaagtgcagatcatgaaacctgaattgcttcttttgtccagttgttaacattttgtagaacccagcccaggaaacataaaatactggaatgtaacatccatgagggtttgtctattttgtttgctttttctccactactcagtacatgataggcccttaataaagattaactgaataaaatcattgaacgaaataaggtctatctttagtatctgatctcctcctatgctaccatcattctaaggcctcctgcttaggtaacatcatgctaggtgtgaaccacttgtaatttttccccagaatactcctttacttttgaaccttactcatcatattttacaaaacaaagatcaggctcttgccctccccatatattagctgtatgactttgggcacattcgtttggttttttatgcctaaatctctgtaaaatagagatagtagctaatgtccattgagcattgagcacttacacttagaaccagtcactgtcctaaaaactttaaatgccttaacacacagttaatcctcagtatcctcctatatgggctatactactgtcattcacctattacgtatgaggaaactgagccaagataagtcacacaacaagtaagcgacaaagcctggatctgaactcagtccacctcctgagatcatgctcttaaccattatgcatactgcctgtccagggatgctaccccactcattggacagtcatgaagagtctacataaaaacacttagaaaagtgccttacttatagtaagtacccaatagaagttagatttttttgttgttattgttttactctatttatagcttctaggatcttatatgttcattgatagatgagtcactatttctcaaaggaaatcagattatttcattttagacagatctaattgggaaaaagtcattcattgtttgtttgatgctcacttaacacttaacttcctgtgactttcctcattgtttctagttcttaactgaggataaagagaggcaagcctagctccactttcttaaaacaactctcagatattcaaaggagagtgtttttgacacctacatagtccattcttcagtctaagcagtttgaatcacttgctgtttctcttatggcatggtttccagatattctggtttgatgcagacacccttatacctggccatctagatgaaaacaaaatattatagctcatatgtggagtaatagctgcatataaaacaggacattgagagaaaagatttgaggatagtcctgtcagtctgaattatattctcagagacagttatggtgccttccttgcatggagtaggttgtaattcttgactgaatgaattcacttataaacaaatgtgttaatgaaccctgggcttactcttgacttaaatccctattcttgttcacatgtacttctgcttctggtgctatgcttctgtgattggtttgggaaacatatagtaggacatcatattagtccctattaaacttcattttgtttgagctatccagtcttccaacatttcagatcatcttggatactaattttgtcatttcgtgtattgtcattccctccaaacatcatgtcatctgtagatttctcctctgggccattaatacaatcctccgagtatttaaatggaatatattatgctcatattctattaaaatattcataagggcttatggcttaaagtgttttaattaattataaatcaatcacatcttagcagtacattttatcatgaattgccattaagaatatctacttatttattcattcaataattattaaaatataaaaaatttttttccaaaatatcacccaaatttgagtaattaaattttttaaaaaattttaaaaatttatgaacattttaatgtgatgggcttctgaaatgaatttgaaaaacgtgaaattaatgtaaactgaaagtagggtcagaccttatggtgctaaccttttcatcatcaaagaaattaactgaaaaagctaaacagtctcaaggcatgtaatacattactattgggagaatgtacaagtagggttgtcatcaaaaggtgaacaatattagtcatctaatttcgtgtatcagaaagaatttccaccaagtactatgaaattcatgaataaaagatttcccacttgtgagaactaaagggctagtaataaaccaagtgtattgttaaataaaagatttaaataaaaatggaagaaagtttcttaaaatgaagtcatacttccttggtggattgcaaaatctaaatgttattaaacaaagatagtaaaattaaaaagaaataaaaagttataccctgaaatattgatgatctcaaaatttagaaaaaaatgtaataactggaatatctcaataaaatatcataattatgtcactttggttagagaatatagctttaaaaattttattggccaatttgcatttattaatttgagaaaacaccttcaccttcattaattcagattaaaattttaattttaaaacaggtttcattctgttgccttccagttgtatattgcttctgggaataacaagtttttttaattacagtatctaccatgtaatctcatacaattttaaaatttaaaggtctctggtattttactagttttactttgacaaaattagataaatggcagattatgtttttcattagtaacatttctcttaacctcatttcatcttaacctcacaggtataaaaataaatacaatcaaattctatcatccaaattggtagattaatagtacttcatatagtcaaataaatgggtaggaatacattaggaaagccaggataacccacagactctctgaaggaagcggattgctcctgcaggacctgggagacaccccaaatactgtgagtgcccaaaccatgaaatgggaaagggagattgtccgccccgagcacatatacccaccagggaacctgaaggtctagattacagaagaagattctgaccttacctggagctgagtcaatttagagagccgagcaaaatacaggggtagaggaagcagcgggaaaatccctaagccatttctgcctggtctcacaggggtccttaagcagggctgccagaggcactgggcaaagtccacatggagaaggaaacctccagttgaactttgtaacaatttgaactgatcaagaagtctcctggccagaactcaggggagggtgtgaatctggtgtgcagactccacaagttggggaagaaagaaagccctactttcgcagctgggaggcaggtagcctggggcaagttctcagccctgctcgcccactgcctggaaacagactctgtgctgttggaaggggcacagtgggagtgagaccagccgtttgaattgcgtgggaggtgggtgagacctctgactgccacttttccctacttccctgacaaccagcatgacacagcagagacagccataatcctcctgggaacataactccatgggacctgggaccctcacccacatcccccacagcagccacagcaagacctgcccaagtaaagtctgaggtcagacatgcctagccctgctcccacctaatgctcctcccctacaccctctggtaactgaagacaaagggcagtatactcttgggagttctagggccccacccaccacctgtttctccccatactgccacagctgatactttcttgaaagcgccacctctcagcaggatgccagatagcacaaaaatagtgcattaatcaaccaccaaagctaaggaacctcacagagtccatttcacgccccctgccacctccaccggagcaggtgccagtatccacagctgagagactcagatggttcacattataggactctgtacagacaacccccagtcccagcccagagcctggcagacttgctgggtggctagatccagaagagagataacaatcctacagctcagctctcaggaagccacattcctagggaaaggaggagagtactacatcaaggaaacacccatgggtaaaaaggaactgaagaacagccttgagccttagacttttcccttcaacagagcctacccaaatgaaaaggaaccaggaaaccaactctggtaatatggcaaaacaaggttttttaacacccccaaaaaatcacaatagctcaccagcaatggatccaaaccaagatgaaatccctgatttacctgaaaaataattcagaaggttagttattaagctaatcagggagtcaccagagaaaggtgaagcccaatgtaaggaaatcaaaaaaatgatacaagaagtgaggggagaaatattcaatgaaatagatagcataaataaaaaataatcaaaactttaagaaacaatggatgcacttatagaaatgcaaaatgctctggaaagtctcagcaatagaattgaacaagcagaagaaagaacttcagagctcaaagacaaggttttccagttaacacaatccaacaaagacaaagaaaaaagaataaggaaatatgaacaaagactccaagaagtctgggattatgttaaacgaccaaacctaagaataatgtattcctgaggaagaacagaaatctaagtttggaaaatacattttgaggaataattgaggaaaacttccccagccttgctaaagaactagacatctgaatacaagaagctcaaagaacatctgggaaattcatcacaaagagatcatcacccaggcacactgtcatcagattatctaaagttaagacaaaggaaagaatcttaagagctgtgaggcaaaaacaccaggtaacctataaaggaaaactcatcagattaactgcagatttctcagcagaaaccctacaagctagaagggtttggggtcctatcttcagcctcctcaaacaacacaattatcagccaagagttttgtacccagcaaaactacacagtcttttccagacaagcaaatgctgagagaattcaccactctcaagccagcaataaaacaaccgctgaaaggagctctatatctttgtggggtttttttgttttttgttttttgtttttgttttttttttgagacatagtcttgctctgtctcccaggctggagtgcagtggcgcaatctcagctcactgcaagccccgcctcccaggttcacaccattctcttgactcagcctcccgagtagctgggactacaggtgcccgccaccacacctggctggttttttgtatttttagtagagacagggtttcaccgtgttagccaggatggtctcgatctcctgacctcgtgatctgcccacctcgacctcccaaagtgctgggattacagatgtgagccaccgtgcctggccaaggagctctaaatcttgaaacaaatcttggaaacacatcaaaacagaacctctttaaagcataaatcacacagaacctataaaacaaaaatacaatttaaaacaaaaaaccaacgtatacaggcaataaatagcatgattaatggagtggtacctcacatctcaatactaacattaaatgcaaatggtctaaatgctccacttaaaagatacataattgtagaatggataagaattcaccaaccaactatgtgctgccttcaagagatacacctaacacataaggactcacataaacttaaggtaaagggatggcaaaagacaccccatgcaaatggacaccaaatgcgagcagcagtagctattcttacattagacaaaaactttaaagcaacagtattaaaaaaagagaaagagggtcattatataacgataaaaggccttgtccaacatgaaaatatcacaatcctaaatatatacgcacctaacactggagctcccaaacttataaaacaactactactagacctaagaaatgagataaacagcaacacaataatagtgggggacttcgatattccactcacagcaaaagacaggtcatcaagacagaaagtcaacaaagaaacaatggatttaaactataccccagaacaaatagacttaacatatatttacatgacattctacccaacaaccacagaatgtacattctattcaacagcgcatggaactttctccgggatagaccacatgataggccacaaaatgagcctcaataaattcaagaaaattgaaattatatcaagcagtctctcagaccacagtggaattaaactggaaatcaactgcaaaaggaaccttcaaaaccatgcaaatacatggaaattaaataacttgctcctgaatgatcattgggtcaaaaacaaaatcaagatggaaatttaaaaattcttcgaactgaacaacaatagtgatacaacctatcaaaacctctggcatacagcaaaggcggtgctaagaggaaagttcatacccctaaacaccttcatcaaaaagtctaaaagagcacaaacagacaatctaaggtaacatctcaaggaactagagaaacaagaacaaaccaaacccaaacccagcagaagaaaggaaataaccaagattagagcagaactaaataaaattgaaaccaaaaaaatacaaaagacaaatataacaaaaaactggttcttcgaaaagataaataaaactgatagaccactggcaagattaaccaagaaaaggagagagaaaatccaaataagctcaattagaaatgaaacgagagatattacaactgacatcacagaaatacaaaagatcattcaaggctaatacgaatgactttatgtacacaaactagaacacctaaaggagatggataaaatcctgggaaaatacaaccttcctagcttaaatcaggaagaattacatactctgaacaggccaataacaagcagtaagattgaaatgttaatgaaagaattaccaacaaaaagaagtccaggaccagacagactcacagcagaattctaccagacattcaaagaagaattgatgtcaatccttttgacactattccaccagatagagaaagagggaaccctccctaaatcattgtatgaaaccattatcaccctaataccaaaaccaggaaaggacataatcaaaaaagaaaactacaaatcaatatccctgatgaacatagatgctaaaatccttaacgtaatactagctaattgaatccaacaacataccaaaaagataatctaccatcatcaagtgggttttataccagggatgcagggatggtttaacatacacaagtcaacaaatgtgatacaccacataaatagaataaaaaacaaaaatcacatatcatcttaacagatgtagaaaaagcatttaacaaaatccagcatcgtttttgattaaaactctccacaaaatcagcatacaaggacatacctcaatgtaataaaaaccatctataacaaatccatagccagcataatactgaatggggaaaagttgaaagcattccctctgacaactgaaacaagacaaggatgcccactctcaccattccttttcaccatagtattatgttgaagccagagcaatcagacaagagaaagaaataaagggcatccaaattggtaaagaagaagtcaaactgtcgctgctctctgatatgattgtttacctagaaaaccctaaagactactccagaaagctcctagaactgataaaagaattcagcaaagtttccagatagaaaattaatgtacacaaatcagtagctcttctatacacccacagcgaccaagcggagaatcagatcaagaacttaaccccttttacaatagctgcaaacaaacaaaatacttagaaatatacctaaccaaggaggtgaaagacctctacaaggaaaacaacaaaacactgctgaaagaaatcatagatgacacaaactagtggaaacacatcccatgttcatggatgggtagaatcaatattgtgaaaacgaccatactgccaaaagcaatctacaaattcaatgcaactcccatcaaaataccaccatcattcttcacagaattagaaaaaacaatcctaaaattcatatggaaccaagaaagagcccacatagccaaagcaagactaagcaaaaagaataaatctggagccatcacattacctgatttcaaactatactataaggccgtagtcaccaaaacagaatggtactggcataaaaataagacacatagaccaatggaacagaatagcgaactcagaaataaaccctcatacttacagccaactgatctttgacaaagcaaacaaaaaggtaaagtggagaaaggacaccttattcaacaaatagcgctgggataattggcaagccacatgtaggagaatgaaactggatcctcatctctcaccttatacaaaaatcaactcaagatggatgaaggacttaaatctaagaccggaaactacaaaaattctagaagacagtgttggaaaaacccttctagatattggcttaggcaatgatttcataaccaagaacccaaaagcaaatgcaataaaaacaaagataaatagctgggacttaattaaactaaagagcttttgcatacaaaagaaacagcagagtaaacagacaacccacggagtgggagaaaatcttcacaatctatacatctgaaaaaggactaatgtgcagaatctacaacaaactcaaactaattagcaagaaaacaaacaatcccatcaaaaaagtgggctaaggacatgaatagacaattctaaaaagaagatatacaaatggcaaacaaacatatgaaagaaatgctcaacatcactagtgatcagggaaatgcaaatcaaaaccagaatgtgataccaacttactcctgcaagaatggccataatcaaaaaatcaaaatataatagatgttagcctggatacagtgaaagggaaacgcttttacactgctggtgggaatgtaaaccagtacaaccactatggaaaacagtgtggtgattccttaaagagctaaaagtagaactaccgtctgatccagcaatcccactactgggtatctacccagaagaaaagaagtcattatatgaaaaagatacttgcacacgcatgtttatagcagcacagtttgcaattgcaaaaacatggaaccaacccgagtgcccatcaatgagtggatagggaaactgtttatatataactatatattttttaatatatatatttatatatatataaatactatatatataatactatatataaatactatatatataaatactactagatactatatatatactatatataaatactactatatatagtatatataatactatatatataaagtaccatatatatatatataaaaaaatactactcagccataaaaaggaatgaattaatggcattcacagcaacctggatgagactggagactattattctaagcaaagtaactcaggaatggaaaaaccaaacatcgtatgttgtcactcatatgtgggagctaagctatgacaatgcaaaggcataagaataacacaatggactttgaggtctcagggggaaagggtaggaaaagggtgagagataaaagaccacaaattgggtgcagtgtatactgcttgggtgatgggtgcaccaaaatctcacaaatcaccactaaagaacttactcatgtaaccaaactacctgttccccaataacctatggaaataaaaaattttaataaaaaaattaaataaaaacaaagtaatggagcagcctaaaattgcatatacatggcaggagttattggaatttgttgcagtcatacaaaatatatattttctttgtgttaatattgatgtaaccattttcgtagctcattttgattgatcatggtaaatcaccttgaaaaggatacactctgttgcccaggctggagtgcagtggcgcaatcttggctcactgcctcgtaggttcaagcgatcctcctgcctcagcctccccagtagctgggattacaggcaggtaacaccaaacctggctaatttttgtatttttagtagagatgggatttcgccatgttggccaggctggtctcaaactcctgacctcaggtgatccgcccacctcagcctcccaaagtgtttggattacaggcatgaacctccatgcccagccattttgtgtttgattttgatctctgttttaaagagaaaaaacactgcagctgtaaagtagacatcttctatgttccccctccgagtcgtattccaatccctccttcaccaaggaaattacttctttgaatttggcatacctctattccatatttctattttgaaatgcatgtatatgtattcatcagtatatagcatagttttttgacttgtgtaaattgatttgtgctatataaattttctgtacttgcttactcacacaatattgtttgcaagatctattcatcttatttcatacataaaaatatagataattcattttcattgctgttcattttaacaacatattactttttcatcatttaccttatactgttgtttatttaggttgtgaccaactttttaatattattctgtaattaacatttttacgttgatttttctatattttagattatttaggtaggatagttgcttagaagtagataagaaagtttttgaggtgtgagattcatatttgaaaatgttttccaaaaaaattacagtttataatctcaaaacccatttatgagagtgctcatcttatagcactttcactagcattgaatattccaagttattctggagttaattcactaatttttaacggaaacaactgactttgtgattaaattaagtagcatagaaaaatgtgatcaatgtgttggttgaatgtaagccatttagttaaattccaagatccactttaaaatcatctattgattatgaaatgctattgtatcattttatgttgtggttttgtcttcttttcagaaaggccatggatctgctatgctttatctgtgctattcttaggaagtttttgaagcttcctctgtaacacattttattataacatccagtaataaaaatatctttttttagaaatcaagcatatgctttactttattgggtatttgtgatcaccaactctcttcattattttggaatttcagttttaagctctaagatgatgtcatctttgtagccagaagacctgagcagcaatatcatctgcagttatgtaaacttcatcaaattattctcattttccagaggaaattattatcagattatttatccataaagtgggattattatcaccttattatgttcttaaatagattaaatgagatcctttaaaataaagtagaaatatagattagaatcactgatctctttccaagtagccatagatacctaaagtccccagtaaaacccagaattagagaaatttcagaggtatgattgatcatctttctctgccactttgcctgacacagccaagagagcaatttatgcagtgcatcacaggttgcccaaatccttggaaatcatgaaaggccttatgttcccacagcatcctcacccacctacacaccaagattttatagtttgtaccttagccaactctccccagagttacaatttgaattttgccattatccaaaacaacttcagaaatcttgaatctctaaattctaccataaattctaatttttccttcttccacttctgtctgtcccctcgctcctgctacactcctctccgacctatggaaacctgacgtcttttgtttcttctattttctcctagactcagttcccttcctggcccagaaaaaaagttataattgttatcattgatataactcttttgattgctctcagtgatgcctctcaaactacttcaatatggaccattctccccaactgctgatgtatacaaaattcttgttgccttatgttaacagattacctcatttcctacttcatcaagaaaatttgagatcttcagaaatgcctccctcaactaccagccctccttccaccatgccaacttacacccataccatccctgcagtcttccctccagtctgaacaaatgaggtgcctcacttctattcagtgtcagcccctccccttgtgctgtcaatctcctcttcattgtcccctcttggaatttactcagtttttttttttgtaccatcttatctatctttaacctgttcctcttcgccagtgtcttcatgtcagctttcctttcccttgacccctcagttttttttatagccccttaacttttctcctctcctctcattcaggctttacaaataatattctacctgtattgtgtctatttattttcttcttatttatcttcagctcactgtaagatagttatcacctgaaatgtctgtattagtcaggattctctagagggacagaactaataggatagatagataatataaaggggagtttattaagtagtattaactcacatgatcataaggccccaaaataggccctccacaagctgaggcacaaggaagccagttcaagtctcaaagctgaagaacttggagtccgatgtttgagggaaggaagcatccagcatgggagaaagatgcagcctgggaggctaagccagtctacccttttcatgtttttctgcctgctttatattcgctggcagctgattagattgtgcccacccagttaagggtaggtctgccctccccagcccactgactcaaaaattaatctcctttggcaacaccctcacagacacccccaagatcaatactttgcatcttttaatccaatcaagtaaacactcactattaaccatcacaatgtctatcaccaaggttactagtgacctactgtttttaaaatggagtgggtatcctcgatctcttatttcactggacacctttcctgtgtaggatgctcttgttcacttcctttttcctaacacaactctattcattggactctagtcacccttacacttctggacgccattccttcttgttgctcttcctgttttcagccctcaagtattagtgtcccttaaggtactgtcctcagtcaactcactctagttcccctcacattccccttggagagctcattcacgtgagtttctacttccgtgatacttctaagttgtatctccagctaatacttctaagttgtatctccagctaaaacctattctctaagcttcagattttgatgccaactgattcctggtaatctccacctatgtcctccaggaacccgaagttaattatgatcaaaactgatttcagtctctcccatttatctgcttccaccccaatactctgcatctccattggtgacatcaccacatgctgggaaactggaagacatgtttgtgcatgactcactccctcgcccccatatcctgtcaccaagtcctaccatttttatcttttaaatgtttcctgaagcagctgctttttattcctcattacctctttcattaccagccctgttaagtttcctgtttttgtttttcttttttcgaataggatagagtatatatacagaacaccaatctgccaaaatcacttcccattaaaaatattttaattatgctccgtcacttatgcaacaaagtctatctcctttaaaaaaaagaaatacaagctttgagtttcttgagggcagagaccataccatgcactatgactagtataatgcctagcacttagaaaatgtttaattagatcttacttaatgaagggatgaataaattatagaagtgctgtgtatccattcttctcattctttttttcatacactgtcactgtgtggcagtgacaatactatttaccaaataatccacatcctccctttgtatttcccaggcttccttgtgctaagggtgaggccatataaatagttctagacattgagttataagcataattgctgcatggcacttgcagcccaatatctttaagagctgtggtgaattttccacactctctcttcccttgctttggctctcctgacaatcttgagatggtatcacaagataatggggcagaaacgcatgctggacatacagtagtaggaatagtggaaagtaagccttttgtgttaaatcactgagatttcagggttaatttgttaaaataacataatctaatccaccctgaataataataatgtttacagttacaagtttatacatcagtctctgtcttattgtattcatatgagcttttgttgaaccttgcccagtgggcagcccgtttgcttctccttcataagcataatgcataggaaaaaaacaaaaaaacaaaaaaagcattgggaggctgaggcaggtggatcacctgaagtcaagagtttgagaccagcctggccaacatggtgaaaccccgcctctactaaaaatacaataattagccaggcgtggtggcctgtgcctcgggaggccgaggcaggagaatggcttgaacccaggaggcagaggttgcagtgagctgagatcgcaccactgcactccagcctgggtgacagagtgagactccgtcgtctgcgaggagaggaggggagggaagaggaggggaggggagggaaagggaggggaggggagcaacacatgagtgatgttttccagttcacctgcctgttgctagccagccctctgtctcaaaacctctgcatatcagagtgtgctccctacacatgatttatgttttccattcttgcccagcctgacatataggcagagcagttcattgcctgttccctatgatctaagtgacagtagaagtatttttctacatgcatacacacacatcctccatactacctcatggatgcctttcatttcacagcagaatgccatgtctctaattttaaatttcaatccttgttataaaggaaacttctcccaagaatcttaccacgttctattgcaagcacaggctaaaggaatctgagactatctccaaagtagatctggaagtcttaagccctcctaatttgttaaggatgtgtagataacctccaatgacctacaattactaatattctcatggtaactttgatataattccattcttttctacaagtattctacaaagtgcactgcttttgtattttggaacctaattagattccagattttattgaactgttttgtattttgttgtttcagtaagtaataattgtttcagttagaaaaaaaaaaaaaaaaaaacagaaaatctgccttccaggcttatataatcttaccaggatctatcctttagctccactttctgtagaaatgctccatccttagacaggctctcctttttttgtcatgcgtgaagttcccaggactgcagagaaaagcaataagcaatagtgttttccccagaagtcacaaagattcactgctttgtatgtgttctgaatgggccatgttcccatcctggatcaatctctgtggccaggtggatacaatgcactagttagctgaggccttaatcatctcccaaagtggtaaaaaacaaacaaacaaaaaaggaatgggcttcaaaggaagcacaaggcctaagaatagggaaggggataatttctggagaaaaattaggctaccgctaggaaggttttgatgttggcagcaatagcaacctctattctctctatacagtctgctgcccgaagttagaatttagagacagcatctagttagagaaagaaagtgtttctttatatactacatgttacactttgatcatatactctctgtcccttctctgaacttttaaaacatattctaaagtattctcctatatgctgccttggttttagttatttataaatatttctctcccctagatctagatctagatcatcagctatttcaaggcaagtactggtggttatatggcatgtacatacaaggcatgtaccgcattgtacattacatgtagtaggcatccccaactattcaacaaataattattcattgacaaaatgaaaggattaaaagtccatgggtcttcaggtggtagcttggggactgattttttaaaagtcaatggggcttattcatcttatgcatagtattaggttggtgcaaacataattgccgtttttgccattgaaagtaatggcaaaaccgcaattacgtttgcaccaacccagtattatctcatcacagttctgtaacccctgtgtgtgcatggatgtttgtgtgcaaggcgctaatacacacacagtaagaagctactatgtgcccatggtaagcaacagggatgtgaggatatagtgattacaaaacaaacattccccaggtcttcaaaagtttatactctagtgacaaagacagatgcttatcaaatagagtgtaatcagtactccaaagaataattgtaaggtattcagggagaatgtatgtgagtaatagatcttcaattttattattattgttctaactgattccagatcaattccaaattggctgtcagggaataccagttttcctagaggtctgttaaaggtggaatttcttagatgcttaacactagattcccaaataaaagctcaagatccaagaaattacatcttatgtttgtgataagtaaaaactaatttaattttgttttcctctctccttcctccccacttctctcccagcctgaagttctggatcaaatacaaaatttgagggagttatggatggataataatgcattacaagtgttacctggggtatgtaagtttttattctaccatgttgtttaatatttgttatacgtttgttgtatttgatcataatctcaactcttaaatttcagtatttgtgtttcaaagtaaaataatactcattaggagtgttcagtcaccaagtgttttcaccatttttttttttagtattttatgtatctttttgtgagtgttataggtatacaaaacgtaagaaagatttttcttattccctttggagtatatttgtcatctcttcccacatttactgttctttaaaagctgaaagaatttatagttatatttttaaaaagcaaaataccatatataataccaagttttatttttacaaaatcaaccttattcttacaggtaactagacaatggtttttattcattttgttagagctcttctacaaaataaaaatctctctcagttcaggtgattttcaatagaacccatgtgaatttttgaaaatggcaaggatcatacagtattaaaaacagaaagttaaaccagagtcaaattttttcctcaactaaagtccagcccagtactatctcctgagtataagtttaccagtcaactcattgagtgtgattattcctacttttcccatctaacaaaagaatgttcccataaaacgctgccccttgccacttgcatacacacacacacaccaagagagagagacagcgagagagcgcaaacacaagtctccctattgttttgtataactccaaactcctggcattggtctaagtagccacagcaggtgaatatgtaataaatcttcagccaacacagaggtttagatgtgtattctcaaaaccagttttatttcttttttgaattgacattaaaaattacttaagatgacagcaaaaccaacaagaacaagacatttattctgtctttgaataagcataagaccacataaaggagaaaatctgaaacaaagattatggaaaaataattaatgcttttatcaaaagatgcatttttaccatcaaagacacaaaacagaaaaatatgcacatctattgttcactgatttatttaaaaatcatgtaccaataaagctctatgaatcagaaactatgctaatgtcagggttacaaagataatacattcaatgaccttgaatatatttgtttgagaagctcgcacatagcaggataaacagatctggatttcactactcatagaagagcctgatttgtgctatagtcaaggtatgtacaaatcctgaggcaacacgagacacttaccaatccctgtgcaaagattgaagaatcagaatatatgccagctaaaagtttatacctcttcttcaatatatttatttattaaaaattacatagcatttaccacgggctaagcattctctctgtgttgtacaaatgttgattcattgaatccctacaacaatcctatgaagtaagttctactaccatccccattttatagatgaggaaactaaaatacaaaaaaagtaactggcccaagataacacagccagtaccccagggagctgtaattcaaaccagcgccagaggctgctgttgactgtaaagctcccaaaggctctctatggaaccaatagaaggtacaaatgagaattttacttttcacaattgttacattcccaaaatccactgtgcaaatcaactcacatgccaaatttctcaataagtttgttatttaagtggaaaggcagggatgaaatcttccataaaacatataatgctgcctaatttgtctgtctcgagagtagatgtttcatatgtactgctagctttatatagattccttactttattttgtatacttgcacttggtaatttgttatacgctgtgtgggaataccctacacctccctgccagaaatagccatggctttctggatgttggcgctggcaaagaattgcttttcagttaccccaaaatacttggctttgaatggttcatcttgagtgtggtctccagcctatgtctgtcagtttcacagaataattaaaacatttaatatcattagccatggggaaaagaagcacattcatttttttcttagttcatgtatcataataaagttaatatactttgtgaatacttttgaatagtctgggctattattttccactgtgtttttcacaagtcagagaagcaaatagataatgatcaaatatttagtcttttacatagttctatcttgtgaccatcaatctaaggttaatcaaccaaaatatgactaaatcatgtattgaattcacatttattttaaacaaactccagtatcttcttttacttgtggcttctactctttccatttgctgcactgctcacctatagacccctctatgcccagagaatgtgggatcaacattcaatatcctcaagcactgtaagaatttatgcctttacagtcctcaggctatgattgctttgatacagtgttttcaacatcaaagtgttattccaaaaagaatgtttaggaactgcacaccaaaatactaaattacgctgaagatagcaatgaaggaagctggaagcttcaaggagaaaataaattttctcatgatatctcatgataaaggaacaaaaaagaaacacacacacacatatcattctttcattgctcaatggaaaagaagagtgaacttaggtaacatgatagttccttgggatggaaagctatgagtaaagtgacaatatttttccaagtgacacatttccaagcatgaggagaaactctgactcatccaaagtactctgattctagctagcaaatattcagtcactcgaagcctgtgctcacactctgcacccacatgggaagctgagggagcagggctggagatttgcactgggttaattaaggatatgtgccctccaaatggactttgtagcctgtagtctgataaaattgagtttgaaatcagctccaccccatattaatgggataactttggagtgttacttgtagtagatgctctcatgcatccttctccaggacttaagaatttactctattcccccagcttctggaaatgctgcttgcagctctccagccttcttcagaaattgcctcacgtaaagagaacatcttcatccacggtcataaccccattcccagagacctccatccaatgatcagtcaatgcaggtatataaaggctcagcccttcatcctctactcagaacaacttcagggcaatcccaacttcagtgatctttgaagtgccagccaaggactttcttaagacttcatcacagcccaacttctttgtctacccaatcctgctccctttctttcctgtctcttcctttctactggtgttgatcctaaacactctcaaaaacttctttctttgtctctgcttcccaaggaatccaacatgtgacatgacttaatctccaatatttaatatgtgttaaaatgtggattctgattcagcagatctggggtgggtctgacattatactttttttttttggatggagtctcgctctgttgcccaggctggagttcagtggcatgatctcagctcaccgcaacctctgcctccagggttcaactgattctcctgcctcagcctcctgagtagctggtattacaggtgcccgccaccatagtcagctaatttttgtatttttagtagagacggggtttcaccatgttggtcaggctggtctcaaactcctgatctcgtgatccgcccaccttggcctcccaaagtgctgggattacaggcgtgagccaccgcgcccagcagagattatacatttctaacaagctcccaagtggtgtcaatgctgctggtctgccgaacacattttgggtagcaaaaacataaaatattgaatcaaataatatatataaagtacttagtatagtgccaagtgcgagcttgtgtgtatgtaataaatttatgtatttattgtgtatttgtttatttatactctgtcaagtaattagagatggtaaagtatgcacaggtagaccagataaacagatgaaccattcgttgagtaactgaaatgtgtggaacatttatttacaaaacatgccctaaaggaaaaggaaaatgaggacctttgccctgccctaactcctctagtccgtgtcccgcccacatgttcactccttgcccaagatatgggttgatccttccctctcctcagaaatcagttactaatccaatcattccacttctaactttctctggagtccatcccctcttcatcctcacttctgttgccttaacagctaaaatacttctatatccctctaacagatctccttgactccagcttttgaaagttccctgaagttactacttctaagcataaatctgttcatgtcattccccatattacaatccttttgctttccttgcctataaaatagagtttgcatttcttcacgtgacatagaaaccctttcagcatctggcttctccctgtaatctcaacttcatcactatactcagccactttgaatttcccactcttcctcaaacatagcatgcttcgtcacactttataaaggcacgtgctgttctcccttccaggtacaggttctcttcttttgatgagcagcatcttccaggccatttgcagcccttccctgttctgtggcattcactacatgcttttttattgcacttgtcacagggtgttataattatttcttacttgaaagtttccttcattactgagaactccttactgataaaaactttgtcttcatcatggcaagtctgtccccatacttagctgtcttattcttgattgttcttgaatacgtaacacagatactggtgcatagtagatccttcaaaaagggccattgaatgagcaaaacattgactctaattaatagggtaatctccaaaattataatttaaaacctttcttatgcatttgaaattttaaggatctacatgtcaatgtcattgtttcagtggcagcttctttagttgggagttatttattttattcagtgccaacttcaagattattgtgtgttttctaactgctgcattgagatataattcacataccatatacagttccgtggtttttggactactcacatagttgtacaaccatcaccacaatctaattttagaacattttcatgagccctaaaagaaaacctgaacctattagccataactcccacactccccatccacccagctcctagaaaccctactcaactttctatctctatggatttgcatattctggacatatcatataaatggaatcatacaatgtgtggtcttttgtgactggcatctgttactttgcatgtattttcaaggttcatacattgtataacatgtatcaatactttattcctttttattaccaagtaatatttcattatatgtatatgccacatttgatttatgtgttcatcagttgacggacatttgggttgtcaccaatttttgacattgtgaataatgcatctgtgaccatttgtgtaagtttttgtgtgtacatatgtttttattctcagtggtatatgcctatagtggtataaccctatttattgttgagtcattttgagaaactgccaaacagttcttcaaagtggctataccattttacattcctactagcaatgtttgaagtttacaattcctccacattcttgccaacacttgttattgttgtggttgcttttaaaataaactttacagtgtagtggttcttacaactttaaaatgtcttgtgaaagtctctcaactaaccctgagtttatgcaatgtcatcaagtctatagggaagttaaagatgttggtatacctggatatgtcaaaaaacagaatagaaacagttgacatggacatttctggatgtgaagcccttgaggacctcttattgtcatccaatatgttgcaacaattgcctgattctataggtgagaatataatattttgtcacaaatatttatgtcaaatataccattttcttttttggaagtatagtttgtctatagatataggtaatatactgttagtctgatgttaataaattttaaaatgtgctatggaaatcataaaatagtatctaacaaatatcttaagtgaaatattaactcgtttccaaattcaagaaggctcttctgttaaaatgatcctaccaaattgatattgtttaaaaattgttatatctccaaagttgcaaaatgttattataaggagtatgtatgttttcttcagagtaatttaataatcatgtatgtatccttatattatgatagaattacaatagcttccatccataggatgttgctatattctatttgtaatattgttgtaacattggtataatgtaggagtaacatataaaaagtataaacataaaatgtcttcttagttctattatttttaaaaagtcacatgtccttaacatgttaagattcattagatcaaataatttgccggttagtgtataaaaagcactcatacatttttgtttaaggatgtttacatgggccaggcgcagtggctcacacctgttatcccagcactatgggaggccaaggcgggtgggtcacgaggtcaggagttcaaaaccagcctagccaatatggtgaaaccccatctccactaaaaatacaaaaagtaccgggcatggtggtgcatgcctgtagtcccagctactcgggagggaggctgaggcaggagaatcgcttgaacccaggaggcggtggttgcagtgagccgagattatgccgctgcactccagcctgggcaatagagggagactccgtctcaaaaacaaacaaacaaaaaaagtttatatgagtaaaatagtgaaagactcatttaaataatgtgtaagcttttttgtgtaggtatcttgctgttagtatttgtaagagaactctacgaaaagggtaatcattaaattacttaactttgtaacatagattttaacctctttgaaacagatgtgttatatgttctggaacttaatcattattaagattgactgaagttcagaatcagtcttctattagcaatgtggtgctcttatccttcgtggatgctgcagatccaatccaagccaacttgtgacttgccatagttttccacagtgaattttctgtttcccttttcactagctccacatatgagttgtaaatttttaatcattattaagttccagaacatataacttttaaaaattaagccatatcctaggtaatccagttgaagatgaggcaattttccaaatttttcttcaatacattattacttctacttagccattctttgaggctgataaagaacattagttttagcaaaattgtggtccatcgtttctttcttcctagaattgttgactttttatttacaaaatcccatattttataatgatatttctctaacttgctcaatcatgggtcttaactgagagttttattaaacacttccacatttctaggctttgtctcttaagattctgattcagtaaatgtgacaagccccttgatctgtacttttattaaacatcttagatgaaacttgtgatcagacaaatttaggaaatactggtttatgttgtaacagataaggaagtatgattatagagaacatccactggtcaagatgacagagcaacttaatacataaccttacactcctactcaccaccatcccataccattttaaatatatcttgaaaatataaaaactctatatattcaaagaacatatttttcttcattactgactcctcagtgccaagaactgtgcctggcatattctacgtgctgtttgaacacttagtaaataaaataatttagccacactcacccaggcatggtggcatgtgccaacagtcccagttactcaaaaggttgagacaagaggattgcttgagcccaggaattcgagtccaccctaggcaacatagcaagactccatctctgaaaaaaaaattctaatttttaaaaagaaaaatgatgtttgcttaagaagaatgaacatcaacctgaacctgtgatagaatggaaatccagcaatatctccaggcctgatgggctacaaaccacaaacagcagctgtaagttcagttcttaccgtgaaataagaaatagaaggactttaagcacaacagaggaatcagaacttacaaaagattagggcgggacctcttttctgtgaaaagggactgaaaaatttacaactagtatgtggagctacagaaaagggaaataacagaaaattcactgcggaaaactatggcaagtgacaagctggcttggactgaatctgcagtatccacaaaggataagaccaccaacattgctaatataagactggttctgaactccagaaacctgggggtcaggtggaggtaaccagaaaactgccagacagggagaagtgagcatagtgaagggggaaacattcaccctcacaaatgagcttgcaaacaaaaatgttgaaggaaactaatgttgctttgacaaccaaaaattcaaccaaataggagaatttaccctaagggaaacaaaagttatcaaccaatatgaaaactattttaagcatgtatagaacatcaaatagataaaagaataacaattaggtgttatagccaaataattagggccagtgaaagaggaatcttttatatttaaaatgctgaaacacaaataataagacttatctaacaaaaacctgagctatgactaaaaatagatggttaagaaaaagaatcaattaaaaatcctgaaaatgaaaaggaagatattggtcaaaggacaccaagttgcagttagacaggaggaataaatgataagtatttaaattgacagatatgttaattagcttgattcaatcattctaaagtgataccactgcatcactatgtacctgataattatatacaattttaatttgccaaaaagttttcaaaaataaattttgaaaaagaaatcctggaaattaaaataccacattaggtatgaaataccacatagggtaattttaaaatacaacagctataatgaagaaagtatgatatagtcaggtataaaatttgtaagttggaagacagtgctgaggaacagaacaggcacatagaaatttgttaataagaaatattaaaaatgagttaagagacacagagaatagaatagaaattgcattctaaaaatgaaaaagcaaacaaattaccttctccaggaataaatacagaattccagaaatacagaacagaataaatggaaaagaggaactattcaaagagaaaatagttgatattatttttcaacattaaatacacaagtaatttatcataataaatgcatacacatagtgctaaaagagataaatataataaatttgcactggctcattgttctgaaactgcaaggacaaagaaaagtattgtttaaagctgccatagaacaaaaagagcttatctacataataataattagagatgtcttcattgtcatcagtgacaatatcttctggatagcggagtaatatcttcaaagtactgaaggttaattacaggcagattggatttctatacccaagtaaacattcattcaagagtgagcacacaacaaatatatttgaacatataccaagaataagagaatctgctcttaaaagatgtactttactcagaaaacaaaaacaaactcagaaggaaggaagtgaatgcataaagcaatggcaagctttaccaaatttaccaacttaatttggtaaattaagtaatttaattaagtaatttagtttaccaacttaatttggtagaaattaagaaagaaatctcttcagtatttcttagttgggagtataggatgaagagatggagacttgcagaagggcaaaagtagagagaaggaataggataaaatacctttgattactctagagaaaagagtctaagcacatatgatatagaaatgcaataaagatgttatttatgaacttaatttggtaaattaaattaattaaattactcaatttggtaaatgaagttgttatatctaaataattagtgcctgtaaagaggaatcttttatatttaaaatgtttagacaggattaaggaatgtgaaggaccttaccttattcaagcagaggctagaaatactgcataactttagaatttgcatgatattcagttaaatagacatgttaaaaatgtaaatgtatctacttaatagaaatgaagctgatacttccaaaccaggagaggaggggaaaagttctgaaagaaaatattcatacggtggaagaaagaaaaataaaatgtaaaaatgataaaatagaagttataaataagatggtaaaaataaattcaaattgtcataaatcacaacaaatgtaatagatttaattgattacacttattctattaaaagatccagaatttcaagttcagctatattgtggttatgagacatatctaaaacaaaacacagaaagtttgattttacaaaggcaatagagttggttaccagactgggcaacacagcaagttcccaattctacaacaaattaaaaaattacccaggcacagtggcacacacttgcagtcctaactactcaggaagctgaggcagtaggattgcttgagcccaggagttcagaggttgcagagagctatgattgtaccactgcactccaacctgggtgacagaatgggaccttttatcaaaaaaaaaaaaaaacaaactggtagaaaatgaagcattattattaacatgatataattgtttgtatgaaatagtttcctttaagaaagaaactaggaaattagccttctggtctgaagaagtcagcatgtaataggtaacagagaatatcaagctagacactggattggcatatgacagactaggataggtaggtggtattatatattttacaccttcatttatgacctgaatggttctcaaagtaactgttgtagtagcttactccttgaactatctttggaccttattgacctgtcagggaaatttgtatttatacatctgcagagttgccacagtccctgattctaaatgtagagtagctgactctcctcagagaattccctttcttggtcaaaataaatatctggaataggaaactgagagctctgttctgaggccctagaatggttcattagtgataattggatggcgaattgcatcgtgtcctccttatttggatcatggattatctattggactaccgacatttaaaagaataaaagataagaatcttcatagtattaatagagggatatggcaacttaaataaaatctttactttcttcatgccttttttagttcctctgcagctatcgggtatttgaatggaatgatatactcaacaacaagccccgtgtgctgagtcactttccctgtgctggttccagggcaaatgaaagggactcttttcctcttctagatggagagttttcataatcagcttctttggatagcagagaaactcaataaagaaaaataaaagaaaaagaaatattttttgcttaataatttatcttactcacttaaaggttaagggcatgggctttatagttaggttacttagagttctgattctggcttttctaccttacttgctgtgtgaccttagacaagttacttaatcttgcctcagtttcatcatctattaagtgatagtagtaatagtacctgacatatagtaaacagctattgttacaatataatatttattataatcttagatttgatgagtgcacaactatttcctttcaaagttctattatatatttgtaaatgtaaatattagcaaattatattaatgtttaatgtattaatgctgactgcatatatgtgtgtgtagttaaaattgtaggaaaaggccttctttttctatctcttcagtatttcttagttgggagtataggatgaagagatggagacttggagaagggcacaagtagagagaaggaataggataaaataccgttgattactctagagaaaagagtctaagcacatatgatatagaaatgcgataaagatgttaaatgctggaggaagacatgagcaacaagggtgaggcttgcagcctaatttcatcccaggggcaatcataattctacagaagctccagactctgtccgaagagtatcctcttggatggaatatgagtgttggcaaaatagccacacaacaaatgagtgaggttcctttaaacccacagacttggagctgagcaggaactaaattgcttcaacctttaaagatattgaaaaagatgcacttaacaaaagtttcttgtgagagccactactccagtcttcaggataatctgtcacatcagcatttagccttaggccccaaccttcctcaaggttttctctccattacttcagagctggagactatgatcctctgagagtactttgcaccctgactttgtgacgtttgctcagtcatctgtaacccactcccaagcttcttgtgacccgattgagtgatgttgagaccatcaacccacatacagctccactggcaggcaggacactcgtctgatccaggctaccaagtcacaaaaaacttagctataagtcatactttcctgttttctttccacaactcaaaaacaagctcaggtgctcttttatatttccaaggctgatactgtaacatatgctctggagaagctaaaatgattcaatcaccttttgaacatagatggatatggcagtggattttcaaacttcaatgataaattgccacaatgtgaactgtccctttcccaggtgatgttgttttcaagctgatgtattcagttcccaggtacttgctcataacagtctgatagtgataacatttctctctactgcagtagagattctgattgcttctgaagaatacataacagagcatactgaaatgtgaagtgcagccacagctttatttcagactttttgtgacttactctatgcctgttaggaaccctcaaaatatttgagaaatatgggcatgatctatagccagtttctcaaaacatgttcacaaaacactagttcaacaacatactgtgcaccacacacacacacacaaagacacacacatgaattccataataaatctggagagtcacattggtatgttaaaagctcctagacaaactattaaagaaagctatttaattttgtttaatttggcgtctctcaaaacatatatgatcatgaaacttactatgtcaattagtaaaattttttttttgcagaatgcagcaatctatagtgtacatgtgtagttccaatgtaaaacaaaatttgttaagtgttaatgctttgcccttggatttggactatttaagccatatcaatattgtaggttattttatggttggataaggaagttgattatgccaaatgcagctgttcttcaattactgtgtgactattgctcattaaaaccctgggaagagagcaagccattaagggtatggaggccataaatcagataatgaaagataaatagttgtaacttaaattcttggccagttctaagtttttgtgcttattgctgatccaaggcaggatttatggtgccaaaaagaatatgacgtcatatgttgtaaatttccaagaacataattataaccgctgcattgcaatacttcagtattcattttcgttgatcattggacttaattcagatttgttttcaatttgtatcacaacagcgatgttagttattactgcttaggaactaattaaatattaaatcacagctggcttgaaaaatttcaactggtccatttgctgaagaatacaaaagggaaatgtagtagtattagtgtcaactggggtgtatgtggagctgtatgttttgtttatttctctgcatttatattcttgaactgtcattgatgtatgcaacttttttgcaactagaaggtcaaaattagactacacacaaacgtcagttttatgagtgtgtattagcagagtttggccaattagcatgccaagcattcaacacaagtgattcatgtgatttcttttatatcacatttcctgtcataatctgctcttatgtattaatcaaccttcttctctgctttaggacttttgaaaaaactaacaactctaaaagtagatgacaatcaacttacaatgctacccaatacaattggaaagtaagtgccaacttttcattccagtctgcctctcaaaagccagaaactaaaggatatattgagttttctaattcaaaacattttctactaaagataccaataatcctgttcatctgtcagcttattttaaaccatattttatttatatatatttgtgtatatcttaattttatatctaaacattgcatttgatatccaactttataatatcatgagaaatgtttacccatgaatctttcacaaggaaaatgattacccagaccttcaattatactcttgctgatatttttcagatattattagtttgatgtttttgactgagtagcagctctgaattcacttcactgtttcttgcaaaattaaaccaatttttataaggctctgcaatatgtatatgttaccattacactattagtaacatttaatatttatagaatcttaacgtatttttagaagctaaggagaaaagcatctgctttagctagcattttttaaaacttcaagatgaaagtctaacattgccttttaaagataaaatatactccatttatttgataacaatttatttctaatattgtcattaacatttggtttacaattctttaagaactatatatattatcaatgttccattgaagtgcttttgtttacaatccgtgtaaagtgagaaatcagtagaggctgtcttcattctgaaattatgtaagggcattttattgagatcttgccctacatcctagtgtgaagaatcatataaattcttttttttttaatttattattattatactttaagttttagggtacatgtgcacaatgtgcaggttagttacatatgtatacatgtgccatgctggtgcgctgcacccactaactcctcatctagcattaggtatatctcccaatgctatccctcccccctcccccaaccccacaatggtccccagagtgtgatgttccccttcccgtgtccatgtgttctcattgttcaagtcccacctatgagtgagaatatgcggtgtttggttttttgttcttgcgatagtttactcagaatgatgatttccaatttcatccatctccctacaaaggacgtgaactcatcattttttatggctgcatagtattccatggtgtatatgtgccacattttcttaatccagtctatcattgttggacatttggattggttccaagtctttgctgttgtgaataatgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgacttttgaatgattgccattctaactggtgtgagatggtatctcattgtggttttgatttgcatttctctgatggccagtgatggtgagcattttttcatgtgttttttggctgcataaaggtctcttttgagaagtgtctgttcatgtccttcgcccactttttgatggggttgtttgtttttttctagtaaattcgttggagttcattgtagattctggatattagtcctttgtcagatgagtaggttgcgaaaattttctcccattttgtaggttgcctgttcactctgatggtagtttcttttgctgtgcagaagctctttaattagatcccatttgtcaattttgtcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcctagcaccatttattaaatagggaatcctttccccatttcttgtttttctcaggtttgtcaaagatcagatagttgtagatatgtggcgttatttctgagggctctgttctgttccgttgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttcaagtagttttttccaattctgtgaagaaaggcattggtagcttgatggggatggcattgaatctgtaaattaccttgcgcaatatggccattttcatgatattgattcttcctacccatgagcatagaatgttcttccatttgtttgtatcctcttttatttctttgagcagtggtttgtagttctccttgaagaggtccttcacatcccttgtgagttggattcctaggtattttattctctttgaagcaattgtgaatgggagttcactcatgatttggctctctgtttctctgttgttggtgtatgagaatgcttgtgatttttgtacattgattttgtatcctgagactttgctgaaagttgcttatcagctgaaggagattttgggctgagacaatggggttttctagatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgtccattcagtatgatattggctgtggatttgtcatagatagctcttattattttgagatacgtcccatcaatacctaatttattgagagtttttagcatgaagggttgttgaattttgtcaaaggccttttctgcatctattgagataatcatgtggtttttgtctttggttctgtttatatgctggattacatttattgatttgcatatattgaaccagccttgcatcccagggatgaagcccacttgatcatggtggataagctttttgatgtgctgctggattcgttttgccagtattttattgaggatttttgcatcaatgttcatcaaggatattggtctaaaattctcttttgtggttgtatctctgcccggctttggtatcaggatgatgctggcctcataaaatgagttagggaggattccctctttttctattgattggaatagtttcagaaggaatggtgccagttcctccttgtacctctggtagaattcggctgtgaatccatctggtcctggactctttttggttgataagctattgattattgccaccatataaattcttactgtaacaaatttggtattctcaagaggggaaagccttatttttttaaatagctttattaagtataattgacatacaaaaaactgcacatatttaaagtctacaatttgataagctttgacgtagctaagaagccttgaaactatcaccactgcaatgaagacagcgaaaatgtctgttacctctcccccagtccttctccccatcactccctcatcacctgccaagtcagcatatagcccctcatctagaaagcttcacttttatagagtggaacaacttgctaaaattcaaactcagatgttcagactttgaagagtagtaaaagtctcagccatttttttttattttaatgccctcactatacagtgtgtttctctgtacagttacttgcattttctccagtatagagcaaagagaacttaagtttaggggtacacaaaagtaattatctttatcagcccgatgctttttaaaagcaggcactaagataggcactagtctttcttctttgggtcaatactcggggaaactgaattcaacttcttttatccctacttaacgtcatgattggtatttgcctcttatgttcatatttcttataaaactaccctggctctttgaagacaaattaaaaagcatcagtagcctaaaaatagacaaggaaaggtagctttttcagtaggaagtagaaccctgactttggtcatcttgagaactagctttgctggtaatttttggccagaattttggcctcttgacctcccaggtgaggacctcccagctttttctggagtctggtatcagcccatgaccaccactggatacatgtgtgccttgagctcccgtcacatcccagagtgagttcctgcctctgaccttcaccagcagtacctgatgccagactttgcctcaggaacaggcaacttgaagctctaactctgtctcctccccagcagccaagtggggcttgcagcctggctctgtacacacagcctaaactacagtcagtcttagtttctatgttaccaccagaatttagtcatgtcctttgaaatcttcctggtagttgaattgtaaatgttgagaaaactgagctgtttaaatagtgacctggtataagcttttatactactgtattcaaaaggaacagatttggaaacatcagttggctgtcagcagctttcacttgcttggacaaaaggcttattccagaaaagcagggtgagtgactgagaattagagcatctatgaacactgagaaggcagaatagggaagcttcttattgaaagctgctcattctcattaaattttcagatgccacaaagccagaaaaaaatacttatgtttggtgacagaagcagtatttcaaaagagctggacagagtgggtgctttgttgaaagacccgataaaactttaatagagattcttagggaagtagggagaaatcattgcttcaattggccatcatcaatatagccaatataataatggaactgtccagaaaaccactgaagcattagctgggtagatggaagtatccactcaaaattaataggtactaatagttcaggtgttctctgacacttctgattctgtcagttctggacatcatctatgtgaattgacaagagggcgaccagcatgagagatgtggaactgtgatttataggagaaaaagcagaagaaatttgggatgtacatcttccagaaatttttttttgaaatcatctgaagtagggatgtaactacttgagaaatagagtatctaaaagtgtgggaccataggcccaggtcttcttctgtaaagttcctgttccacttccagacttactggcacactgtgctcttcctcactgtaggtcctgggagcccagaaagctgctgctgccacccactctagttctggactcattcttcaataatggcttcagagtaggggagtactttcaattcccaccctacttgccttcgaagacacaaatgtctagggatctttgctatagggctttcctactaattactggggaaacattgccagaatataacaaaaaattcatgctacaaagttcagaagttttattataaaatgtataaacagcctatacaggcctgatgatagtgataatacggtcatgccaatagttgaccacatatacaactgtgctcccataagattataatactgtatttttactgtaccttttctatgtttagatacacaaatagatgccattgtgttacaattgcttacagtattcagtaaatcacatgtcttatagttttgtagcctaaaaacaataggctatatcatataacgtaggtgtgtaatagattacaccatctaggtttgtgtacatacatctgtaatggtcacacggtgatgaaattacctaatgatatatttatcagaattcatcccagtcattaagtgacgcatgactgtaatcacatctgccattcagtaatcgtaccactcttcttgttcactaggcttcagccacactggcccttctcctgtgcctccaataagctgggcttttccctgtctcagggctttcttatttgttgttacctctacctgaaatattctttccccactcttcataaggctgactacttcacatcctctaggtccatactcttaaacatcagtgagcattcaaattatctgggaattttgtttaaaaggccggttctgatccagtaggtctgggacctgaagggcctgggttctgcccttgtcacaagctcctaggtgatgttaacaatgctgcagattcacgggaaacattgtgaataacaaggctatagatttagatttaaatatatcttccacagtgaggccttccctaaatgactttccaccaatataatcaccagcaaatttcctgtccctgttccgactgtttctttcatgatacttttcgcaacctataatttttattttgtcatctcattattttattctgtctcataatgtatatacctcacctcaattaagatcatttttgtttcccagctccagaattgtatagtttctgaaaattatcaacactagatcctaacctacttttgtttttgattccattatagttgttgtatagtaatcagaacaactatatagaaatcgaaatcagtgttctttagtaagaggatgagaatatcaaacattaatgatgtttgtaatgagtatggcttcatatttagaactgtcatgcacctactctcctactgaatgccttgattcagagttaaaatacaaaataagaaatagagaaataaaaaaaagaaatagagaaattatgcaagtgaatatggatgctaggttattcacatacttcgttttattctcattttagttttaatggataattatcttaaaagtattaaaaagttttatcaaaaataaaagtttcataaatggccaaacgatttatgtttttaatgaaacattctatctgtaacttggggcaatgaaagcctggaaatgtaaagaccagacgcagtgaccgaaaatattcttattctgcacacggaatatttcagtatttcagacttatcttaaaaactcctggaagaattcatttttcacagttaaaatggattccatgacatttgtgccaaatgacttgtaaaattagttattttgttgttgctgaaccttactatgtgcctgggagtttcagcagctctaagagttgaatatcaaataataatgagcgcctttttttgtactcacagtgttccagacctcatgtttggtgctttctttacaggtattatcttatttacttaaaggcctcattagcattatttgatatgtattatgtccttatcaacagatacagaaacagaggcagagagaagtcaccagacttcaatgccaagctgttaactgaactatatgtgatgcgtctttatatatatatgtgatagttgtaaatatgttattttgtaaataacttcatatttggtcattcagtgggtcccataagtctagctgcgaaggagataccacagactgagccttatgttcttagctttgtagtcttgggtaaaagcaatgaaaacttagaaatctgaaaggttgtttttaaaagctattccttcatagagtgtggtcaaacagaaagactgctggactaggaatcagaaaatctaagtgtctatgcaaagctagataaatcccttcttctctatgggcatcagaatcctgaagggtaatacatgtggctttgagatgtgaagtgacttgccaaaggtcattaatagctatgacataaaagcaagcttcatggacaaataattttggaggactctgtatacaagttaaagaaacactgctaacttatcatttctttttccagatgtaatatcagtctcatgtttatcttttgtatcatcatttaacttgttgcttattttgccatgtcttctcaactagaatataggctccttgagggctggatcatgtcttgaacatttctcatttccttcattgtgccaagagagtatggcccagaggattgtttgcaagccttggaactagactttggttttgatcctggctcctccacccattcactaactgaccatgggcaagtcatttcatgtctcagagccacatttttctcatctgtaaaatggaaataataataattgtcagaaattgttgtggcacttagaactagataggcttcaataaattattacagtcattattttattaatagtaaaatccaaaaagacatttatttactgatcattgcttatgttcatctatatgaggtttggtgatataacatgaatgaaatatctggttctaaaaaagaaaaatataagtatttgcaaatgtagtaatagtacaatgtcttagtctgctccggctaacataacaaaatatcatggatggggtggcataaacaatagatgtttacttctcacagttgtggaagctggggagtccaagttcaaggcaccagcaaggtaggttttattctgagccctcttctcttggcttgtaggcgaccaccatgttgctgtgagtttacatgacctctttgcatgggttggttgtcggagggaagaacaagccctggtttctcttcttgtaaaggcattaatcccatcatgagggccccacccttatgactttatccaactctaaattacctccctaaggccccatctccaaataccatcacattggggattaacacttcaacatatgaattttggagggaaacattcagtccataacatatatcttttaaacttacaacatctactcttaggagatgaggtgtttgaaattgtttccatgctttgtgacagagtcctgaagaataaactgttttgaatcatagcagttggttttcaagtcaaagaacttagagcaatttaaaaaagaaaagaaaacaaataatgcatttgccagagtaataaaggcatcttcacatcggcacacacaaagttattgagaaaagtacaaagaaatgatcaaatggaatttcactgatgattgtataagatttcagttaaagcacaaaaccactaatgatatccatttaagagtcatcctccttcactgcctacttcctcctccacttccttccccagcatttcagaattgtgactgtttatgtcctgtgggcaaatattaattgcagtacttactcctgcatgcatgaaatgtttccatatttttcattagttaagaaatctttcagtctcccaacttggaacatatagtatctttaaaaaaaaaaatagtctttgctaatgaatgaagctattctctactcatcagttgcagatatgttcactaaaaaatactttaaacaatatttcacatttggatgatatttttctccaataatctaacgtaatttttttgcaaattctattttcaagcagtctaatcaactttctaaatagtgaaaaggaaagcaacggtttctagttgttttagatagatgggaaaattgggttcaaatgaaaagtttattatctctatgataatgatagctgcttaaaatcactcaacatttcagaggtaaaatctagatgattttgtttctaatgaatgcgttttcgtcatactttcactgaattcagcataggccgtgagatttggtactaaaatggggtgtgttttacttggaaaacagtatagaaaagaattagtctgactaaagtttgcaaatttcctaccattatttagaagcagcccaagcaacttatgtaatgttaaaaagaaaattaagaatggaacctaaaacttgattcctagcctaaattaagtgaaattgattgtagaatctctgaaaatgagtatagcagcaaaagttacttaacatttgctatgtgcccattctaagtgttttacatgtactaattcctttgtgtgtgtttaggccttatgacacgtggttaagtactgctgtcacccacttttgctcagtgatgaaactgaggtacacagtaattaagtaactagtaattattagggtctagactccaatcccagctgcctagctgcagttgggtgtctactttcggttatactggcatttttagacagtgaatagttaagcagctcacctttgccaaacaaatctctctctctctctctccccccggctctctctccctctctttctctgtctctctccctcttcctccttcccttcctccctgcctctaccaccctgcctgtctctctctcctatattcctctctacttctctactaaatctttgttaatacaataatagtttttcagagtcatctgaaatttacctctcccacatattactaaacaattttacattttgtggaatagaagtcagttttattttatgaaacaactgatcttaacaagggaatatcgcaggacaacttttacacgcttcagaaatagattgttcaagattcgtttttttttttccaggtactctacctcgtaacagaccactttaatgggatgtgatatctattccatttagcattcaggggttttgcatatatttactcttcattgaaactctatatgttagatgttatcaaccaattttatcggtgagaaaacaggggttaatagtagataaaggtcactcagctattaagtatctacactagaattggagcccacgcctgtctcaatattttccactgaattacattacttctgttaagaattaaaagtgaattaagaaggtgaagcccaaagccaattatttttatatttattatcatctacattgatcatagattaattatatctaatggtcaccaatgatgttaaagtgaaattataaattatctatgtagtatattcacaatctttcttccctattagctaggtaattgagggttaatgatacagtaatattttcctatccaagagcaactcatgaacatgaaactaaagtagagaaaactgtacagaatatttttagaaactgaagtcaatacagctgatttcaaacattattactcccagtagcatcattcattctgaagcatacatgacctaaacacaactattgtaatatttatatgtagtttagcatttattgatatgtctattttatgtgtttaaatgatactcttgatagatttggaaaggttttatttaaatccttgcaacttattgtgtggcccctgcactggcagcatctcatcatctaggagctggttatacatgcaggacctgggcctctccccaaaccactgaatcataatctgcattttattaagttctccttgtgactggcatgcacactgaagtttgggaaacactgctttaaagtacttcacacattctttgcaacttatttttactttccacaattataaaaataaagcatctgaaaaaataaaggtaacctttggtcttttttttttcacttcattacaaatgtcagtggcaatctgattaaatatgataactgttttaataccggattttgtattaaaacaacttaaatgatttttaacaaaatagccaccaacaaggtcagctggaattgtaggttatgagtttgaatctctggaattttagagatcattgaggaatatgtgttttgcatctggaagatctttgttgcaacccaaagatgtaaaatactttcaggctctaaattattaattccttattgcccatggtgcagtcaaaatgtttttttaatacaggaagtccttgctctgcagagtagtgcgggactgtatagaaatcaccaaacaattgtgggcgcctgtattcccagctactggggaggctgaggaaggagaatcgcttgaacccgggaggcagaggctgcagtgagccaagatcgcaacactgcactccagcctgggcgacagagcaagactcagtctcaaaaaaaaaaaaaaagaaagaaagaaatcaccaatatgtgtttttcctactgaattatcaacactcaacacagactagttttgatcgctgatgtgtatgggatttcccacaccaagcaactttgcagttctcagtggataccagctgggtgccctacagtttaactcaatttcgacacacctacctgaagttagaatcagatcccacaggttcagggctcagtcccacaaaactatccccccttttcagatgccaatcacaagtccaggcctcctgtacttctggctgaccacctataaattggggctccctatcactccctcctgaggtttaatcacttgctagaatggctcacaaaaatcaggaaaacacattaaccagtttattataaagaatattacaagggatacaaatgagcagccacatgaacaggtacaaaaggaaaggtgtgtgagaagggatgaggagcttccatgtccttgctgggtgtgccacctgcccagcatttctgtgtgtttagcaacatggaagctctccaagccttgaccttttgggtttttgtggagtcttcattatattggcctgatggatcacatcattgcccattgctgatcaactcaacgttcagcctctctcccctccccagaggtcagggggtgagaccgaaacttccagccctctaatcacaaggtggttcccttggcaaccagcccccattctgaggctatcccagagcccttagccataagtcatttcattagcatccagaaagacgcttatcactttggcaattccaagggttttaggaattctgtgccaagaactggatgaaggtcaaatatgtatttcttattataaatcacaatatttcacagggatcgtaaaaatgaccttgcaatctgaaactgtgcaaaacagtcttaataatcaatgggaaacattatgattgttcttagaaaaggtctttaaaaccttttgtccaagcattaaatactgttaatgtaggttacaaatgcataggaaaaatgaaaaaaatagtaaaactaatagttatttttgtataatgtaatattaaacattagaaacactgagaattaaggcttattttaatttaaaaaacatatcagggttagtttgaacaatgcttgccgtcttttcatgatacgttgttaaacagtgtgaacatcttttctttgcattaatgaattgtcatgttccttttaagtttagatccacttccaaaattttatcttttgtgctttcagtgtcatgagatatctctgaaagttcctttaatgtgaggtttattgccagcaacttcctctgggacatcttcattcttttcatcacactttcctcatttatgtatataagtttgccttcactaggtcctctagaagcttatctagagtcttcctagtagtagcagtgtcagcattcccatgggcaactatttcttgtatgatttcatttacgttagattcaaatttatttgtacaatgtgcttgtattagtcagggttctcttaggggaatagaactaatcagagatatatatatatatgagcttattaagtattaacttacacgatgacaaggtcccacaataggctgtcagcaagctgaggagcaaggaagccactcctagtcccaaaactgaagaacttggagtccaatgtttgagggcaggaagcatccagcacaggagaaagatgtaggctggggggctaggcccatctcgccttttcacatttttctgcctgctttacattcactggaagctgattagattgttcccaccagattaagggtggatctgcctgctccagcccactgactcaaatgttaatctcttttggcaacacctacacagacacacccagaattaatactttgtatccctcaatccaatcaagttcacattcagtattaaccatcacagtgctaaaagtttattctatgctctatgcatattacttattgtcactttctgccatgatgcttgaatgttttaaattgtatgtttcatgtcatatttcatctagaacacaggtaaagaaactgcatgatcaccagttgtagcatgaataccctattcaaaagtctgtttaagataatacactttaaaagttgaaataactccttggtctataggctggattaatgacgttttccttggtggtataaagcaaattttcacattttaatttcaatctccaagagaattagggtgaccaagagcattatccaatagttgtagtgctttaatggttaaattatttggtctatagtatctgtctactgctgagagacaggaaggcaacacatgttttgctgtctgtgtgtgagccaaataacagaagggcaatgaccaatcattgacagactttgaaggaagtgacgtgaccggtcactgatcacaatgtacatctgttattcacattgtaatatgtggactgaagaaactgagatgcagttactcatctgaataccaaggtaactgaaatttgagccagtttgttgggagactggtgttgttgaatgaaacatgacaactgaaatgttcacacattggaattgtgcaaggtgacaaccaccttaccaagaccaagactaacttcaatacatgtttttattataaaaaaagaaaaaagagagaaaccttaattatattattttcattaaataccttctttaacttctgcccctgaacataaatctgtaatttttattttaaaaaattcctagtatttatgactccttgctgagtacacgaccccaaactattgatagagacctcttttatgcaattctaaaaaatttattgagtgcattatatatgtaagacccagtgctagactttcttttttttctttctttctttcttttttttttttttttgagaaacaaactctgttactagatccctcacatatatggattcctgcccccacaaacacacatacacagagtaacacagttatgtacacttggcatcccagcaacataaccatccctgcaaatgaggggcctcaaaggatgttgaaacaaatttaaccggtttactgataataagaggaaaaatgtactgaacatgtattttatgacaggtactgtgctaagttcttaataacatttcattttagagccactgcatgaggcaggcattattagtatcctcattgtaaatataaagaatctccagcttagagagaatttctatgatttgtcaatataaaaggaaaaatgtttacttaagcaatactttcctaagagctgttactcaaaattgaatgctgtgtttcaccacaactcattctaatcagctgaatctgttaaggtgatgaagtttgaatgaccttggtcagagtcagactgatcctaattgcattagattttttcatgacccatggacagtggtacttgatttgcttagctgcacacagacttgtgcactcatcccaccctctctataatgcaaattttcaacccttagtgagtataatcatcatgacccactatcaccagcccctcagtcactgatttttcccctcagagtgctactcagtgaatttcttccctgatgtattcccttgcatatcagataaataaaatctgctttgttttttgagctgtggtgttctgtatttaatttattgatacccaagataatacagttagtaagttacaaagctgggacacaaatccattctgacttcaacccatatgcttaatttctgtgttcaattgttaaataaataatggaagcaaattgcattcaagctaactagttttaacataaaaaaggatgctgaccaggcacagtggctcacgcctgtaatcccagcactttgggaggctgaggaaggtagattacttgaggtcaggagtttgagaccagcctggccaacatggcaaaaccccatctctactaaaaatacaaaaattagctgggcgtggtggcaggagcctatatcccagctacttgggaggctgagacaggagcatcacttgaacccaggaagtgggggttgcagtgagctgagtttgtgccactgcactccagcctggatgacagagcaagactacatctcaacaaaagaaaaaaaaaggattctaattctacaaccttactccacctaactcaaattcatttttccctttacattggtagaatcttcacccctgggggttccttcctattataataatagcaatataataggaatagtaagaacagtttaataataatttcaacaataccaacgccaactgcaatgtatctggtgcttactctgtgccaggcccttttttcccagctatctcaaaccaggcattgaagtgtcttgttgccttgtgataatttcaatgtacatctatacaattcctttctgtagatctgaagtaaagccggctaagtatggactggtagggattgtgacaaactggaggcacactgaagaattatgcccatttgaaggcagcagctattaatccatttccattacttgtcatggaagaatacagaccccgtattgacagagctttctctgtttcaagaggcatcaaaactctggatcattatgtaaaattttaaatacttatataatttaacactttctaaaataccactatataaatcaaacaaaacacatctgcaggctgaaatgagccctgtccatagcacctgctaagaggcaggataatacagtgactctctactgtctgcatttaattcccagagttgttattttgtgtggctttgaagaagttagcccctttaagcctcaattttcttatctgtaaaatgggctttaaaatattacatatcttaaatagtttttatgaggaagagaattggtggttttttttttctttaatctctaaaatgcttagtaaaatacctaacattttatcaatgttttgtttttattgtttctcccaactcaatcatcccctggacctgccctctccacccttctccttaccccatgacagttatagtcactcattccaaggatacacattctgaacatctggctacaaagaacacctaagttgtaaacaaatgaaaaattattttgtcgttttcaatggctgttaaataacaggtaaatttagaaagggaaaaagtaaactatatttattttaccaagttaaaccatttatttgatagtattaaatcatttgaactggtaaattatataatattatgttgttaccgcatgaataacttttgttttggtgaattttggatatgtggctttttcaaaacattttgctatctaacttttaaaatgtctaactaatgtatttaacttttcagtttatctttattagaagaatttgactgtagctgtaatgaactggagtcactaccttctactattggctaccttcatagtcttcggacattagcagttgatgagaatttccttccagaattacccagagaagtgagaaataaacttgttttctatttattaacttttaattaatctgttttggagtaaaatcttaacaggtagaatagcaatgtagattcatgagttgagctgtgaatatatataggaattatctacatatatatttgctaattattctattttaaatgacaagttcttatatttgacccagaaattgcatttgacttaaatctcgcatgcaaataaaagtaagaaaataaaagttaattaatgctaggaaatatcatttaaagtcagttaatttatatcttttggttttcagaatagttataaataatattttggagtaattacatttatatttctgtagcaaactttttaaatgtacatatgctttttaaggtatcatgctgcattataatattattttaacttctggatccaccaagagattctgttaatttttacatctaagtgggattttacttactaatatcaaaaaagtataaagtacattttttaaatttacttggtgctcaagtttgctgtatgtgaagtacattttcaattgagcattttctactaaacattcttataatgatgcaacaataaacaacatataattatcttagagccaaaacatattattaaaaatgacgaaaaacactttaatgtgaagcaaaactaactttgcctaggaaatgtcaacaatattgtatttttgagtgtgtatgatcttctgttataaacaaagatatattagtactcacttcgacagacaaaattatatgatatatgaaaacaataatgttagcaagtattttaagcataaaattataaagaaaattcttcatttttaatatgtaaaagaaaatttggtataaattcccttaatatctaaaataatatatataatatacctatattttaaagagctacattataaaaacaaaacaatgcacatgttaaaagttaaaaataagaaaatctactaaattgttttaaaaattagaaaaattaatataaaaatagtattgtggtctgatttttttacctattttcttttgttacctacagattggaagttgtaagaatgtaacagtcatgtctctacgctccaacaaattagaatttcttcctgaagagattggacagatgcagaaactaagagtcctaaatttgagtgacaacaggtatttttgcaacatttcacaatcacatattagttatttgctgaaagcaaattatagtttttttgcctatagttttgataacattttctgcgtttcgacatatacggaatgcaaatactgatactttccttaaaatagcagaaggtaaattattttttaaaccaagtatttctgaattttgttatttgattatatcaaaagcatatgtaatgtattaaaattatataaatatgaatcacacaaatttatatacaaaagccttcccatatgcagaaagcataataatatgaagacatggaaaactataataaaaatatagaaaatatattaataaaaatgtgcatatctatgtatgtatgtatgcacacatttgtgttttcacgtctatattttggtttccaacaaattaactgggcaatgtgtatattttcaattccatcaaagtgctcattagaatactgacaacgaaatggctgtttagtcatgtttagagcagatgaatgaggaaaggataggtcctttacttccaataacggcattatattgatagatgggtaaaaagaaaaagtgcaaacctcaattcatctttgtttccacctactctataaaagataattatcctcaaataggaaaggataagaacaaatattgactagagataacagctaagaaaataaaataatcacaaaatataatgcatgagctctatgttttcaataagtttcaactaggcaattgataataaaaggaactgagagaacttgcaatgaaatgatcaaagattagcttttatggaatcataagaataatcagattttagaagtttcaggataagcattggaattctcatttgtttcttagtttaaggaaaaatgtgaacttcaaaacttcatttactagttaataatattcccacataagggaataaaacattttattaaaaagtttggaatgttatttatagtatcaggtgacaaggaagcaccaaagctttatgcatcaagagcaagtcatgtcaaaccaaccttgcttcctcttctgactgtgttactagcctggaaaatgaggaaaatacgttgaaagttgtttctgacttttggcaagacattttttaaaatctctaattatattgttataaataagattaggaaattcttggtattatgaatgaaaataattcattcatcgtatgcaaaatatacttagcaaatattatcaatgatccataattagaagttctattaatactttgaagatacttattcaacaactgtagcagacttgagttcacctacaatgagccagacacactgccaggtgctagggtgaaatttatgaataatacatagaggagctcacaatgtcagaagtttaaaataaattcatcaggacagaaatataagcttaagttatgtcctagtacagttgctggaacatactatggagccaaattactatttttaaattaatgaatcaatcagtaaatcaagcagaggtaaaaatcaatattcagctaaagttaggccaaagttaaatattaccaccagagaaggaactgtttggagaaaagattaagcaatgtcatccaaaagtaatgattattataattttgtatttaaaatgtactagatttttaaagtttgacattatagttaggaacaatgattcctctgccttgtcagctgcaagattgctcctgtggtcaatgtactgcacatttatgttaccaaataggagctcacttgcaatagaggtcactggaaaaggaaagaaaatcaagggtatcttgcccttttctagcagtttcttcatattctacatttatgactggattgatgatgatatcatggatgttgtttacatgattctggatagttttgcactcatgtaatttcagtgcagcagaattgacattctgcttttaatataccccatacgttgtgaaaaactctcccaataagatcttacttcacaatttctggcttaagtgaattgaaataacttttagttaggaataacttttaggggtaatttggcttaaagttataaatgttactgtaacaattatataaaaaagaattgcgatataatttaatatcagttattctttatattcatgtttatattttataaatatttattagctcagaaaggttactatattttttctaaagttatctatataatgcagttttaatatttctattgcctttcaatctcttttcatatttattagattttaagaagtgtttaactgctttcgctcataaaattaactataaaattaatttttaattactgtaagattgcccacttccattatcaaaataaatttatttatctattggctgacagaattctaatacattaaagacaaggaaattttcattctatattatatctaaaatgtttatctgtattcaaaagtgaatatccagaagttagtaataagtctcattggcatgccttgtttgtactactcactttgctaactagctttgatggtaacccatgtgatcacgatgtgttgatcatgcataatttgaaggatatcagatagtgtgaagtactttggccctccaaaggctgaagccaaagctaaatatataattttgattgaataccaaggctaatatcaagttatacatcttagaagtgctaattttttaaagattacccctttgaatatctactacacattgcatgaaggtcaaaagaacatacttgctgaaggtcaacataatattgggagctgtaccttcctttagtagtaaaacaagcattgccctttgccctcatggagcctacagtttagttttcaagggatagcaaagagtaagcaaattatcacaaaaataaatgtataatttaaaactgcagtatgttccatgaaggaaaatacaaggtgctttgaaaccagattgagggaagtaatttaaatgaggagtcaagaaaagcctctttgagaagatggcatttaagctaagagtgaatagatacgtgggattcagtaaagtgaagtaagggagagagtatgccagaaaaaagagcaggccgatagagccagttgtcctgacgggactgagtcaggaaaagagttgcagataaacttctggagggatttttaggggccagaccttttaagctctaaccatacatgttaaacattttttatttttattcagatataatgggaagtatttgaagggttgtaaataggatattttcatttttttaaatattgttcaggctgctcaatggagaagggattcaagaaaagaatgaaaccaacaagttagagtattttaaataattcttagaaatgaactattatccatctttacccatgctattagactttttgtgtttttgcagattgaagaatttaccattctcatttaccaaacttaaagagcttgcagctttgtggctttctgacaatcaggtaaaaggttttattgcctgatttatttattaagatgaactataattgaaagtttgaattactaatttattcccaatagatacctttgacagcagctacaaaatgtagattgtttttatccccagaaagagagaattttgtaaagatagcaattcaaacattgctgaagtcaaaacagtactgtaagccccaccctccttaaatacttctatttaacatctacttaattctctgagatctaatacacaaaatgatcatttttatagctttttaacttctaggtggtacacgtaggtccttagaggatgtactttaattatatctctgaaggtaaagaataagaaattgttaccacaatccccacaacagggaattattatcctctatgttcctctttcttcttatccttttaattataatcaacttaattcaaaagcttcattaatgacatttgaaatatcaggctgggcgcggtggctcatgctgtaatcccaacactttgggaggccgaggcacacagatcacttgaggtcaggagttcaagaccagcctgaccaatgtggtgaaaccctgtctctattaaaaataccaaattagcccagcacggcagcatgcctgtaatcccagctactcgggaggctgaggcaggagaatcgcttgaacccggggggcacaggttgcagtgagtctagatcactccagcctgggtgacacagcgagactctgtctcagaaaaaaaaaaaaaaaggaatttgcaatatctttttggcaactattagtattttctgtaaaattgttttgatattattttttatcctcttgaaaacagattttaattgaatcagtaatattgcattagtaaataattttattaactggaaaataacaagaaaccattgaagataactgatttgcctacagaagaactaatgatagacaatttttatatagtttattagtcctcttttttcttgtgatccttaaattttgaaacacctatcctcaaatatgaatggctaaatgaaaacaattcatcttgaatttagctcatcattattttctgagcataaaagtagcattactggtacgtgaattgttcatatttacagtcattggacacttgtggaaaatttaaaataacctttacaaattataaaatctaaatataagaatattgtttgtgttcctacagtaattacagcatttgcttccatctgagtcaaaaattagtaattcaaattcaaatcttatcaataaactatagatttttcaaggcatcaatatatcatcataaataatttctggaatcaatgtgaactatgctaatgtaatagtatattccacagtattgcattatgggaaaaaaatatgatttattattcttgtgggagaatgaacagagcagtgactgcatcatttaacttttatttagaagagtaatgtaatgtggttatgactcagtttcatgagacaaactgatatcaaaaatcccctttgtgtttcactcctattaatgtcattaaataagcagatttttagtatattagataatatcatttccaatatatttctgacatggactatcagagttctagaatatcccttcagaatgaatatttctgaaatcaaactaataacagaatgaaatatgcacagaggtcaatatattatgatatatcaggtacaagtacagttgcttatctataaagtggaccctgtctttggctataaaaatatctcttataaataagtgaatgctgttttaacctaattaaattcatagatgatcttgcatagcataaatttgatagcaaattccatttgtctttctagggcaataatccatgaaaatgaataggcatatagaactgtaccaaaagcttacttagttgaaacaatttaacacattttgaactgttcaggattaaatctgacattgcccagttgaataggttttgataagttttgtaaaaggatatactaaagaagaagaaaactttattatgaaaatcttagaatatgaaaatattcctcagtaatagtattatttcatgttgtaatttcttattttatttcttttttcactttttccccccaatgtttatttatctgagtgagaccagactattgactgttatatatttgcaattgtattcatctaatttgtatgttctttgcttctagtccaaagcccttatccctttacaaacagaagcccatccagaaacaaagcaaagagtattgactaactacatgtttccccagcagcctcgtggtgatgaaggtaaattgtcagtagaaatttcttctctacttataatgattatggatagaaataactaattttattcagatctctggccaggagtactggcacatggacaagcttataaagataattacatgacacacaaatatcatttggggatgtactttaagcataagtcttattttctactctattttagataagcttccaaaacaaaactcttcatctttatatcttacataaaaataatgttgatttttaggagcaactatttctctttatggattgcaagacacatgactagtaaagcagatctggtaaccagctaattgaaatgagctaagagcagtcagatcctaaggaagtttcaatgaactggtttagttgctgtgttcatttattgcatgaacacaatttaaacatctagtccaatgatctctggactcaaattatttcatggtctaagtcaaccataaatagatacttgcaaataagaccattctttcttttcaagttgagtttccctaaccaatatccctaaatcctttttcaataattaaatcttctcttctatgatcacattattcatttaaaaaggttaaaagagctttttgtcctttgctatttgaaacttagcataggctccttagcccaagccaacacaagctgatatgaacattttctatagttatggagtaacaataattcttggaagagtaaacttattttaatccagccatggattaaatctactcaatccatgtgaatgaggccaacttgtaaaagaaaccatttgtttatgtatttcttatttccagggataattataataaatgactttagtctttgacctccaaatgtaagtgaatcattttggaatattttaggatatttttctttaaattttgtctacagaagtaggaaaagaaaagattgttttaatatgtatttttataagtcaataaaattaaccttttgaattgataaaagaaaaaccaccatgtttacacattttataagagacatcttaagtaaggattatgttatattcatgcagctttacttatattttcattttaatagctctacattatcaaaatatttaacttcaaaagaatatagggaaaaagtgaaaagtatctcatattcactggtcatttctgagatatgatctcacagattgaatccctaatttgtcccaaggtagattcagttaggtaaggtgtagtgttaaggaattagcctagctgagtttgcttttgtttttgtttttttctttgagaaaagaaaggttggtaattgaaaagtttcctcgaacttaaattaagtcatcctttggttttccaggcaggagtgtaataaatgagttttcagaatcccttgtaacaaagaaagacatatatgataaaggacctcctttggaaaagaatttagccttaactaagtacttttattgcattttcatgtgatctttgccataatgttgcaaagaagatattatcattagccaacattttatgtaaaaaaaagattcataagccatttccctgttaatttgacatatttaaactaactgcaacagactaaattttccacgttttctaccaaaaaacaagctcccctcattgaccccacaataaaaggaaaaggttgcaatcttagataccttattgcaaagtcaatgttatgtggtaacttttataaaagaaatttgtatagagtttagcagttacaaataaggattctatttagacaggaacagaatcctgcactagccactgagaagtctcttaacactttgagcaagtcccttaaaactcattagtaaagtaaggatgagattagtaataccattgtgttgttgtaaggattgaaaaagataacgctttaaaatgcttggtctaactctctatattattattattgtcctatggggaccccatttcctacactagaaaatttcccgatcctgagtattttaggaatactgaatttgagttaagattacaaaagaccatgtaataaatatcaagggaattttattcttttctctttccttctttctctttctttttttctttctttcttctttatttccgtatttgtttgtagtatctatcaccatttttgcatactatattaaatactttgtgtaaaattgttttttaaaaaaacaataatactttggaatctaactgtagatttccagtcagacagtgacagctttaaccctacactgtgggaagagcagagacaacaacgcatgactgttgcctttgaatttgaagacaaaaaagaagatgacgaaaatgctgggaaagttaaggtgaaccttttagcttttgtttcctctttcttctccttatctttttgtttgtccgtttttcttattcagatagattttgggacaaagtcagatacttcttcaagtctcatggcggtacctttcattacagcatgctggtagttctggaagcattggtgtgcttcagaatgagactaatgtcccaaatctgagtgagcaaatttgaaatgccacttcatccaacagaataactgcatgagagagattcaagctgagggaaagtagaaaaaaaaatctgtgtgatagacttcatctaagaaccttatttcattgttgacatgctacacactacgatgattttttttaatcactgagcaaagcgtcatgcagactgaataaggccaaaataaacatttctggaagggccaacagattaatatgttacattggcattaaaatctctgaaaagttctgtgtccttgggctattcaagaagaatttatgagtttccttaaatatgagaacaaattttaaggaagattagtgcctaatggcaggtgatgttccttagggaacataacttcaattttttttacctcaaagtatgttttaaaagatcttttatagggactactaggtcaagtaacaagattgaattttaaaatatgtatttctccattacttacatttttaattatcatcagaattgatttagattttctcaacatcacattttcatgttggcatggcaacatcttgaatctctcatttactttttataacattgtatgtgtactttttctatcatggctactaacagctctcactcttagtgactaattacctttataattgcatatgtgttctattaataaagctagattgtgtgttatgtttgtctctgtcctctcctttccacattttctaaactttatttcttaaatcagcacatgagcacttactggcaaggcctaccaatatcgttacggagaacccaaaatggattcccaaatccaaaataacaattttgttaaagatttgggttttaaaaaaaatgtctctagatagttgattagtgctgtctaacaaccaaagagacatctttttgaacttgtgaattcctagaaaaaataatgctaaactgaaaacataccttcagaacatttcagttcttttacggattttgtatgttaaatccagaaccaatggatgatgcattctataccggacttctgattcatctttatatttcattgaattaccaaaaattgcatgcttcttcctgaaattctgtattcaaagaatgcaagaagaaagtgcatttaatatactctggtatatgtgtcaatgaaaacgtaaaatatagtaaatacttacagttatttagaagccctgtttgtgtgttatgtgttcaagtttgtttataatcagagtaggttcattatactttagagtgttttttctctgtatttacatttggtttatttatgtattaatgaaacaatgtgtgtttcaaaatctcaaactactcagttttgactaatttgaatatttccaatgccattggctattggacaaattagagcacaaacgaacttctaaataaatcatcatggaagtatgatgaatagaatatattgtaatcttacactaaatcacacttttctggttcattacatgtacattaaattcagcaccattttacctttaatttacatgaaatttaaaaaggaaccattgacctatgctttcaactttcaaatggactagagtataatgccctacttacagtctgtatagtgtagtatgaatgctgcattgtgtgaagaaattgtgaccctttagcatcatataaaattagtactgttttatacatggatttaaaactaactttatgatcattattttaaatgcataactcagagtgaaagaaaaagagagtagaaaaatgataaagtgaaagtattgctacagtgctcctctttctcccagaaaatggagattccttctcccacaggatctctcctgccaagccccctgggaaaggggccagcgtgggattactctccaacctgccagactgtctggcgattgctgcacaccatgggccaggtgtgatcagcagatccaagatatgcccgtcccccagaatgacccacagctggcatggggttgtataagtggcctccagcaggaaaggagcatgtgtactccattgccagttgcagcacaatccaccactcttccctctctaagtggcagacaggtaggcctaggtgtctggggtaggagaatctcccatgtagaggcaaccttggaacagtggtttatggggtatgttctgcatgatttggggtaagaaatgttgatcacatagaaaccttcaaattgccagtgttttatctcaatttaacattttgtttattgacattggcaatggggtggggaggactaagtcagaggggagggaatatcaatgtgaggtgcctattggtgggatatctggcatggtttttgagttgggtgcttttttttttctttaatttaaagtgtgggaataccaatagttgggcagaatgttgatgacactattgatacattctaaattgtctcctccacatatatgcacattttttataatgtgaattctgggggagattaaatagctaaaacttaattcttaaaatagcatcagatttaaattgagatttgctgagagtggcctttaagcacaaagatagacatctgttgaaaagcatcaatttcctttaatttgaagacacaaatcgtatgaattcctgtaagagaagattgaattgggagttgtggcaaatagggcttccttatctctgtggttgggtgttttaagaggttaatggggggaaaaacatgtcttactggaatatgaaagaacactgcatgtcttgtaaactttactatccacatgtaatggactagatacttatccattgtcttatatttttgctacaatataaggcaagctgagaatgcattttcctaactaaaattgctataagtttcttttctttgtataacattccaactaattctcgaagtaatataatatttaacaatcaatgatcaaagtattaactaatatttctcttactggaatttacaatcaaatcaaattagaatttgatcatgatgtgaaatatattatattacataatatattataatatattaaaaaacagttctgtgtgaattcaagatatcatttctaaatgccctagctattaaccttaagtgattctttattgctaaatttttgggggtctccaacatcttgcagctgctatttgcatttactgcactttatttacatctaagatacaaagaatgttgcgaaacatttctttttttcaaaattaaagtaatattttagtaaaaatcttgcattttaataaaatgtatatgtgaactgagcaaatactttatagtgagtgatcaacacaacacagttttgcaagaatataattgattttcctacctatgtgtataataaatgaatttatatattttatctcatgctggaataagagaacatttatagtctatatatttagatatatacagaaattgctcttatatttgggtattacttaactattagtataactgggtctatgatcatgtttattcacttctgatgcactgcatatacccaatgaaaaataaagcaaagcaatctataaatgggcataaaatatgcttgcatagaacttccaaacataatacaatgataaattatagtttcatctttaaaaattataaaatattgtgttacttagctttatttaaaaaaatagaaattattttgccatttaactcagagaaattcacattttaaacttacagtatttcttccacaatattgtacaaatatgtgctgcacccacactctgagctaagtaacacttgtgtagcataagcactggagtcaaaagacctaagtctgaatattgcatctactagctatgtaatcttaggcaagttacttacatggtctgagccacacttttctttctgtaaagtggcaacagctgctgcaatgggttgtgaaacttaagtgagattttattataatgattaattatataatatttaataattaatcatttatttttagtgtataaatattaatttatatttaaacctatagaattaataataatgtttatgtaaataattaataataaattaaatatccctgtaaaacatttatcatggtgactggaacatgggagatactgaattaaataactgttgctatgtataattgaaaaaagatccagacagttacagatattatgtttagacatatacagagtagagtcaagatcaccaaaggaatccagatttttaaaatacattaagtaaaatgtgacattagaagtagtatctcatctctgcatagaacttacagattttccaagaactttcacatttttcacattttagctccggattaactcaaatttgtaggaaatatattatcatttccattttacatgagtagaaacaacagaaagattagtggatgatagctagttgggaataaatctatttcttaaatttaaatcttctgactccaaggccagtaaattctgctagtaggctagtaagtgagaagcaaggagcttattttttaggtgaaacaaatgcaagctttataagacctggaacttcctcaatttaagggggggggggtcctctttcagaaaaagaatataaaatgactatgtaaataatagggtccctcacaagactttggaagaggtgtgtagcttaagcttcattaatgcatagtaaatctatttctagatttaaatgtcacaggaataaaatattcaaacatattctggggatgtgaccaaaatatcacatgtgcttgcttataaaataaccagaaaatattagtaccatgccaaatagtgatctaattgtgtcagatgggacacagcatctaacaaaaaatacattacattattcaatgaagtatttaattcagttaaggaagaacacttcacatttcttttgccttccattcaatttctaagtgtagttttagtgttggggattttttaagttgcatagaattttaatttaatgccctactttagcttattttttattcacatacagctggttataaaaaataaaatgttcttaattggcatgatagtcatagcattctacaacttacatttttaatgtaattttttttacttctagcactttgatgtcaagtacttttaaacaagttcaatgatacaatttaaaaattatacttaatttgtgattaacatttctaataccaacttaaacaacagatctaagaatgcatgcatcccaatggactttgtctagtagtcatatcattccttttatgtttatttaagaatacattacaaattaagtaccctgggacttatttatactacaatctaacaacttacacttttttttctgtcaattctaactttgtcttgggttatatttttgtagctatatttctatatattatcaatgtcatccttatttatttgagagtttaaagagattaaactacatttaaacagcacttacattaacaaaattatctggtttttcatttgttttccaaatatttactggaataataattttatatctttaatattaaaaggaatgttagaagtcatctagtgaagtccaattctagtatttgatgagaaaaaatgagccacaaggaagacaaaatgtcgagaagaataacacagttggtggatttgctaaaactgcagatgggcaaaagtgtttgaattcacattcatagttttcagatctatatcaccatcatagtttcttacatcccatgaattacatgggtgtgtgggggtgggtgcggatgtgcccctcactctttctctcccttttccgatcttcctcttcctttcactgcttctctttcaccttctctcctcataccctcccacccccacacacactttccacagatacatacctaccacaatcacataaatcatttcattttgtaaagttgattctactcagatgcaaaacagtattgttggaacaagccaggccaagtaaatcctttttttcccagtcccttttaatttgcatgcacaacttgtacttattctattttaaatatattataacaagtaccgtgatgatgaaatattctatatggaatgtctcatattttctccctctaaatttaatgctaagaatagtcattaacatgtgttcccaaaagttatattgataacctaacatgaattcaagaatggaaataagtagctggatagataaaagccaaattttacacatgtacctaaaatatcttagaaagtggtcccaatttttaatttctcttcattataagatattactcaagaagcatgttactttcttagggtaaaaagtaaatataaaaaccaccctgaagcattttttccccttagggattaatgagaattagctatcctaccttttgatataacacactaactaacagaaggctaatgcctatttaggcagcagatattgtcaactccccagtttttaacatgcaactctacttgtaaagcttttggggtctcctcccatcagctgcattgctactcaaaagatactcttaatatcaacattattacttataaatattaaaatagggaagagaacagtgtctaaagtaagaaaacagctgctataacttgattaaatttttcaaattaccaatcacttaagtgttttgacctactgctatttcagccatctatagggtaggtctaaagacagaatatgattcaaaattagtttataatctagaagggtgggaaggggtgagaagtcccagaaggctgaatatgagaacactatgcgtcctactctataacagagtttctcagccagctcaacactcactgtattgcatttgattatactactgaatataaaatgggatagttttgtgaacatgcttgctgaagttatttttatgttaaatttctttttgtaaacttctaggttgaaataaacctaaaacgatatccaactccttacccagaggatttaaagaatatggtaaaatctgttcaaaatttggtgggtaagccaagccatggagtgcgtgttgagaattcaaatccaactgctaacacggagcaaactgtgaaagaaaaatatgaacacaagtggccggtagccccaaaggagattacagtggaggtatttgaaggttattggtaattgccagtgtggtttggattttttggaattttaaatatgttttttaactgaatagatcttccttgataagtgcatttttttcctaaaatataaatgatctctctactttttcaaactatgagggttgcatttaatcagtcatagaaaaatgataccctcatggcctaaaatcattaacatagctccaaaagttccaatacacacagaatgaataagttcgtcacccagcaaggcctggccagtgagtgcgttatatcatattagtgacattattttggctaccccaaacttttgttgtattaatcattaagaaagactaatccaaggttttctattatgcaaatctcataaaattcctaattagatctagagcacaatttttaaaatgtttttatctttgggttacaacttttctaggaaacaccgattaacaataaaaagaggacataactttgaaatttagatttatggaatctagtcatgtgaagcttaattcctatattttagaatgagttagaaatccatccttattgattttgtggtctgaaaagaattcaactacacttatgccacctctactatttcatcaactcttcagctaatttggttatcatatttttatcttcattagaaacataattgatctgagtacatctgtaagttcacgtaactacttctccaaaatctagagtggcaaaactcttttacaaatctgcatttcagagcatcattttgttgcatttattaaacaccaactgcatatgtaacactgtgccaaacactgtgagagagagaaaagaaatataaaatgtgtcaataataccccaataatttaaagctgatacacttaagacacatgaaacaattaaagagcatattatctaaaatatgatcacatggttagttgagtgatggagaatataatgctccaagtttagtttagactgtatattaaaggtagggtgattctgttaaagaggaaaagggaggagggcattccaagcaaagggaagatcttgagcaaaaataagcatagtgtgcacatctgccagcagaggtaccaacctaccctagaggaggggaatacagctagatttctaagggaaaaaaaattagcattcattttcattgttttttgcttataaaatcagtatcattatactttttcctttccaaaatattatgcacatattatagtaaagcaacagactgttcttttatctcaaagatctcgctgcaatataaaggggaaggaaaccaacatttagcagatacacactaaatacatacatatacgttttatatttaaatatcctgtaatcacagtttaacatcaaaataactggtggtcatgaaaatctataaactggataattttactataaaataagagtctaaaatgtcttcatgtagggatgggatagatgagactttggttatgaatttaataataaatcttaaaactgtctcaaaatcaggtcaagcataacaaatccaaaattagatttaatgtttcctttgcaaacttgcttttgctttcatgttcctgaccttgatctcactggcaccattatcctccatttcattcaagtagaaattcgagagatgtcctgatttctttctccttctttctctccacttcctatctcttccaaataattaccaaagcctgtgcattctcacctaagtgtatcatttctacctcctcaagccctcaactctgtcctgcattactataaaaaaatacccactttttggcttcccttgtccccagcctcctcattgccttgtcaatgatctttctaaaaaagaattctaatcatttccttgccctccttaaaaacactacagtgacttcttattgctaaggctaagattaaagctcaactttcagctttaaatttgtctgtgtgatttgcaccacccctttcctagctttcttctactagtcttttcctcttgaacagaaatttcactggtaatttcaatactttatctaaaattgagattctagatcttctctctctaacttttaaccatcctacagcaaagaggaactgttgctttctgtattatcctcctgcctcaaattaactgcagccaaagtaaagggtcacactctatttttcaatgtccagatttaataaatgcagataaccaagcatttagctgatcagtgcatactaaacatttataatatgttttgcacttctatgccattttttgaatcattgttattagttcacactgcaaaggatatggaagagggtattatacactgcatgatatatttattcatgtgattaaatatagaaaacccccaaaaaaagaataaaggtaggcatgaccagaagtggaaaacggaaaaaataaataaggtaaaaagattacaaatgcaactaaggggaaaaaggaaaggtaaatatttattgctcactttcattttgccaactagatgccaatagttttaacatacattatgccagacaaagaacagggctggcggagccataagaaaaaggaggacagggagattttcctttataatgccttgtgcagtttgcatttgccttttccccagatctctttatatggctagcacttcctcatccttcaagtttcagcttaaaggccacctcagcaggaaggccttccctgatcactctgatcagttggaccctctgatatcctctatcatgtcacattgtcacattaaatataatgaacagttatgattactttgtttattgacttcagactgtgagtttcatgaaggcagggatgctttctttcttgtccatccttgtattgcctgagtctagcacagtgcctaggatagagtaggagcaaaataaatatttgttgaataaatgaatgattgatatagtccagtataatgactctggtaacatgtctgtctctccattcaattagatattcattgaaatcaaggacaatttctgagtttttttgaattaataattaattgatacctatccacacttcatcacctatgtgttcaatacactcttggtatataaatgcccacagcgtctcagtgatgttatggtgatcctagaccaaaataaatacctaggagtttcatttaagttgttatagccaaacagcttagtaaatatttatgccctactttgtggtcatttgaaaaaatcaatgcacataagttgaaagagaaaataatatttttaccttattcttaagaaatcaaagccaaaatattaatggcatacatgcacctgttaaacaccacctatcttctcacagctaggaatcatagtagacaccacaattttaatttctgtttatcattgattttcaaatgccacttggttttttatcacagcaaccaccaaaaacccagcttcacaaggattttctttttttttttttttcctttttcttttgagacggagtctcgctctgttgccaggctggagtgcagtggtgcgatctcagctcactgcaacttccgactccctggttcaagcgattctcctgcctcagcctcctgagtagctgggattacaggcacgtgccagcacagccagctcatttttgtatttttagtagagacagtgtttcaccatgttggccaggatggtctcgatctcctgacatcataatccacccaccttggcttcccaaagtgctgggattacaggcgtgagccaccgctcccggccaaggattttcatcaaaaagaatgtgcgatctaatgttgtaactgagagctacctcaagctagccatttgcacagtgtctgtctaatgtcaattattgctttgtttccctcaaacatttaatgtaactcacagtgtccctgttaattgcaacaacacccatgggtgcctcagagtacagtttgagaatcaaggggtagggcttttaaatctagcagacatgaattgaaatcttggctccaccttgtgaccttgacaagtcaagtctctaaaacctttctgatccttggtttctttatcttaaaaaaaaaaagcacaaaacagaaaatatggtaacacctatttatatacagctccaagcacagttattgacacagaggaagcctacagtaaataattccctcttctttttcaagagaattatgtgccaattccttccccatcctcctttaatccttctgcaagtaactaccaagatacctgttcaccatcccaaaatgttctgcatttttccctttgttaggggactcagcccaatttttttctatagaggaacatctttcttccagtaacagagaattgtccattaccctcaaaattttccttaaattacttttattcatgctaggcctagactctcaaaagctcagaaataagcttgctttctttcctttgacttcttcctgaggcttcttttctttatggcagtagcagccaagatgcagtttgaacagtggaagggcaattgtgagaaaaaggacattttaccttttctttccctctcatttctgtctcctcaccagaaagaaaatatggttcaatgtacttacaatggaatccccactaaattctgttttctaccaaaaatttcctctgtcattgcccgtagaagtagtccccaaaactttgcccacttttccaaaaggaactcaattcctctagcctctataaaagaatttatagaaacaaaattagtgatttatttcctttgttggatagttaactttactttgtgaaacccatgtgagaaatgagctgttctcaggatagacaatacagcatacacagtatcacatagatctttgagtagcgcagatcccagttcaaatcttggctttaccacttattaggtttgtgacttagaattatgattttacctcactgagcctccatttccttatctgcagaacaaaaaatgatgataataaataaataccacataatgataaaaaataaggttgtcttttaaataattaacaaggataatatagatagagtgtttagcatagtagcaccgcagcagatgtaatcagtgccatgtaatttatggccattatcatcattgtcgtcattatcatcattgtcatcatcatcatcatcacttcgttcataagggtaagagaatctactcagatcagtgcaaattcatcattcttgtttcaataatgtccttctaagaagaaatacaagttcataattagctgataatcatcctctcttcctggtcactaaggctgtttttgattcacaatagaaattctgaaacaggatcagaaacttgaacctgagtcaaaccagagctaccatgcagagttccggtcataattttggtatacaagtttgaaagtcgaatcaatacaaacaagatgacctgagtactgaatgtgtagaacataagggaaaaaagcaaaacccataattatgttaacattctgtacttgtacagctatttggattgcttttttgtgtttctattctatttttgtttttcttttgaataaaacaaaattcccattcttgtaattaggtatcataggaatatttttaaattattatttcaacaaataacttacctttagattcatagaatgttagtactagacaggaattggcactaattcctattactgattacctttattttaatgatgataatgcccagagaagtacactgacttgcccaaggtgacctgattaataaaatataaaaatagaaataggatgaaaatatgacaccttgtaacaaattttttggcaagtcagcatattttatgcctttcagggtactgtttctcaaactcatatcttcttataaatttctccaaaggtatataaaggcttttatcctcccttctgtcaccttaaaactgtcatacatttcttatgctaaatctttgaactaactttcaaaatcaatcaaaatgaataatatgtaccctctgaaataattttcaaaatcaatcaaaataaagaaaatatggcctctttaaaaggatttataaaaaaaaaagtcagcgattaatttcttttgttgagtagttatctttcctctgtgaagcccgtgtgaaaaatgagctttacttaggataggcaatatggcatacacagtatcacatagaacacctttgagtagcaaatatagcctcttcaactactgaattttccattctactccttttcctgttcctctttgcaatctgatacctcattttaagttctttgtgtgctcacagctgagctcaccaggaggcagcacaaggtaaggaaagatcactggaatggagcccaggagaatcctgctgcagtgctggatcttcgtctaatcatctgtgtaacctaggcctaagctgagtctcagaacccgcctctagaaaacaaaagtgttggactaaatgatctttcccttttcttttattgaaatattctatttaaaaaattaacaagtaacagatatacccaggtttttcaggcaaatatttccatacaaacctaacccaaaagaatcccaaaagatagaacttaaaccaagatgtgcttctctgcaataaccaaagacctgagcatgtcactatgggggtccttggcaatatataaaatttatagtaagagtttctgcctgttcattataccaaccgattagttttaagacaggactttttaaatttacaatatttttgtcctcaagtatatttttttctctgatttaacaaaatatttctaaatattttacattagtgccccaaactcacaagatactaatgaattaaaaagctgaaaaattctcatttgaattaaaattaatcttaagggaaaagaagacataacgatagctgctatgcataaatatatatcactacttatgggcatagataatgcatttttatatctagaagaaagtgagaatttggtattttaccttcccctaatgctctccaccctgcctggttaactgaaaatagtaatttgaattgtggaagtttaaaatcttgggttttctacatgtttatttgtcattatgaagttatagtcgtgtatcgatgttgctcgttacactcaaagaagggatatagaatgaagatttagtatgctagattaggtgtgagaaaaccaggaacctctggaagaacacatgatagaacttgagaaattgaggagatgatcacttgggatacagtagaaagttaggaggaaagcggtgggaagagcaggatttataggacccgacagtgaagtaatgtagctagggatgcacaaaaaaaaaaaaaaaaaaaaaatcttaattggtcagtgatatactttcctcttaaaactcttagagttaaccacttagaacaattacatgtgtatatatcatatttgtgtgaatcatactgctcatatatggcttatcataattcagtctggtgttctaatgagttatagctcatctctccaactagattataaactcccagagggcaccagccacattttgtctttctttggaacctccacagttcattgcacagtgccaggcatataaacaacatgcaagaaaaattgatgaataaatggactcacttacattagaaaaaaaaaatttaatgcttaactcagagatacatatggtttatttctcccagtgcctcacagtgaactgaattctagagtcacattttttaatctgagccaaataaagatactgccactttggttaaccattgtttaaatgtttactttccttgtcctgtattattatatctctcaggattcttttgttcatccagctaatgaaatgaggattggggaacttcacccttcattagctgagacccctctgtacccacccaaacttgttctgctagggaaggacaaaaaaggtaacactgtgaacccaatgtggaaaatatgctacaaatgcatgtgcatgatgaatcgccagttgtaaattatgatacaccatattctatacaaatgttttacaaatatgcatttctaaccttaatcggtatggtttccatttttcatacttgcttttccgtgtaattgtcagtgtcatagcattataacattttcccctttaaatttcagaatcaactgatgagtctgaagttgacaaaactcactgtctgaataacagtgtttcctcaggcacttactcagactactcgccttcccaggcttcctcaggatcctctaatacccgggttaaagtggggtccttgcagacaacagctaaagatgcagtacataattctttgtggggtaacaggtgtgtttagaattccctccttttgttcccaaacgtttattttcagcaactttttaaaaaatggaatcttcttaattttggaattgtattcggcacacaagtggcatagaagacagaaggggcaggtaagcaaatgttgttcgcctgggactgccaggaacagatgaatccaccttacagggagaggccattggttaaggaagacatggtaggagttaacaggatgagatggtagaacaaaaaatttaaaaaataaaaaaaaatgtgtttgcccactgatacttattgatgagacatggatgttttaacatacaaaatggcattatgaattaaaataaaatgccagtaaaacacttaggtgtctggtccagagtaagtgttcaataaattttcattgctatcgtcatcataattttatcaccacctggaaaagtcaggatgtatttttaagtacttaatctttccaaaatgcctcctcctctatattactctaattttacagatgaaaaaacaaaaaccacacacagagcacaataaagtgactcaataaggcaatgttttcccagttctaattccattttgtaacttgttgctatgttttacactacaaatagcaaattaaaattgttatataggtagtcaataacttttactcatattttactgataatattgccactgttggcaatgtcttctttagtaattcatgagtaacttttcctaatcattgatgctcataataaaaatcataactctttcagtttgtaaattcattatttgcattatctcagtatctgctagaaataacatggtcagtggtacaaacatgtcagtgatctaaagtcataatataatttacattctacaaaacatacctgaatatgctccctatacaatagcatttagtgtcttcaaaacctgaccttcaaataaaagtcatctgaagacaatttagattcatcagatacaccaagcatttgtaagaaaggtactctcggccaatagtttgaaatgtaccaaatcagaatctccaggaatgggtatcaggaatcatatgattctaattatcagtcaggtttcaagaccattacttaagaactacatatttccttcattgattccttcaacaaatgtgtatttaatacctactatgtgccaggcattagtctaggcctgcagagaaaaagatctctaccattgtgagtttatattctagcagaggacacaacacaagatacaatacacgtaatagataagtaaattatatagtatattagaaggtgattattactaggaaaaaaaagttaaagcaggataaagggatggatttttaaaatatgaaataataatactatcttaatcataagtcaggtgaggattattgatcagttaaacaaaggatgatggccctctttgctgcttgttctctttctgccaaagacccaactcttcgtccttttcaatttcttcttcccattgtgttcacaggattgcaccatctttcccacagcctcttgattcaaagccattactcagccagcgggaggctgttcccccaggcaatataccacagcgtcctgaccggctgcccatgagtgatactttcactgacaactggactgatggctcgcattatgacaacacagggtttgttgctgaggaaaccacagccgagaatgccaacagtaatcctctcttaagttcgaaatctagaagcacatcttcgcatggacgcaggcctttgatcaggcaagacaggattgttggtgttcccctggaactcgagcagtctacacacagacacacaccagaaacagaagtgcctccttccaatccttggcagaattggaccagaacccctagtccgtttgaagacaggaccgcttttccttccaaattagagacaacccccactaccagcccattgcctgaaaggaaagaacatataaaggaatctactgaaatacctagtcctttttctccaggcgtaccatgggagtatcatgattccaatcccaacaggagtcttagtaatgtcttttctcaaatccactgccgcccggaatcttctaaaggtgttatttcaattagcaaaagcacagagaggctttcccccctaatgaaagatatcaagtctaataaattcaaaaagtcacagagtatcgatgagattgacattggtacatataaggtgtataacataccattagaaaactatgcttctgggagtgatcacttaggaagccacgaacgaccggataagatgctgggaccagagcatggtatgtccagtatgtctcgaagccagtcagtcccaatgctggatgatgagatgctcacctacggaagtagtaaggggccacaacaacaaaaagcttctatgacaaaaaaagtctatcagtttgaccaaagcttcaatcctcaaggatcagtggaagtgaaagccgaaaagaggataccacccccttttcaacacaatcccgagtacgtgcaacaggccagcaaaaacatcgccaaggatttgattagtcctagagcttacagaggatacccaccgatggagcaaatgttttcattttctcagccatctgtgaatgaggatgctgtggtgaatgcccagttcgcaagccaaggggccagggcgggcttcctgagaagggccgactccctggtgagcgccacagaaatggccatgtttagaagggtcaatgagcctcatgagctgcccccaactgataggtacggcagacccccatataggggagggctggatcgccaaagcagcgttacagtgactgagtcccagttcctgaaaaggaatggcaggtatgaagatgaacacccttcatatcaagaagtgaaagctcaggcgggaagttttccggttaaaaaccttacccaaaggaggccattgtctgcgagaagctacagtacagagagttacggtgcctcccaaaccaggccagtttcagctaggcctactatggcagctcttttggaaaaaataccatctgactataacttgggtaactatggtgacaagccatcagataacagtgatttaaagacgaggcctactcctgtgaagggagaggagagctgtggtaaaatgcctgcagactggagacaacagctgcttagacatatagaagctagacggttagacagggtatgtctggtgtttctctgtaagaatatccctcctgcctttagtgttactttattggcatttctaagcacatgtagtgaagcatgaactacatgaatgaattagatgatcagtattttatttatctttatattgtggggaaaatggatcataatagtttttcatggatgtggctaaatgctctttgagagttcataacctgcaggtgaattattcatcaaatctaacccaaatattgttagtaagaaagaattcaactccattagaggggatggtgcttcaaatgctttctagccattaaggcaaaatgcctctcctaggacgcaaaactgttctctagtgacctaaagagtatgatttttgttgaacctataaaaagtggatatttcccccgtttctggatggactcacttatattaaagtcaggcctaatttgtttataaaatttgcacatagttactgctatgggactactagttattatttctaatgagcaataattttcccaacaagaaacagaaaaataagcagggattgaatgccctcctacacattattttatttaataaaaagcctgccatttagaatgttggtttttatatagaaagaaatatttaaattcagattatactacagacaacaaaaatagttgatgtctttatgaagacagcaaacaaaaaattagtatgtatattgcagcaaaaaagaaaattaattctagttcagttaaaaattgagtcacaataggcgaggcatggtggttcatgcctgtaatcccagcactttgggaggccgaggcgggcggtcaggaactcgagaccagcctggccaacatggtaaaaccccatctctacttaaaatacaaaaaaaattggccaggcatggtggcgcacgcctgtaatcccagctactcgggaggctgaggcaggagaattgcttgaacccaggaggtggaggttgcagtgagctgagatcacaccactgccctccagcctgggtgacaaagtgagactctgtcttggggaaaaaaaaaataaattgtgtccacaataaagcatgtaatatgcagggatcagggacagaaaaaaaaatcatatgatgcctagaattacattttgttgcctgtttgaatctctctaagagaaacctgtactcattttctagaactatcttcaattgaccatcgtcattcagtgtactttgtggcttttagggtagagggcttaatgtgctctgcattgacattagaatcttaaagatctttttggtgaaaatggggctttttgttctcattttctagggctgaatgctcagtgtaaattggggatctgggtaataatatactatcgcattgtctcactcaatagttttattattttatttggtgtcctgctaaaagcacaggtcactgcatttattaggtatttctttaatactgaattttacgtttacaggtttactcttttcaaataattatattgcttgtaggtcgtgtctacatgacaagaaaacaattttttttagggaaggagtgaactaataaatgtgggtgtgggtgttagtttctcaatgtagaaattggttctgccttgcaaaatatttcatcagaatgtctgtttcaaataggtttgctcagtcccattgaagggagcctcatcaaagcctcatgactggctgtcagtgggagacacctggtcggttgtcaccatgccttacctcaagtataccctccatgtagacagataacttggagggcgaaaatatttggggccaaataatacagtacagtttgggaactctggcctcgtgtagacacgaccatacgtaacagggtaagatgaactagtcaagaaaggttataagaagctttttggagcatatgtacaatgactagtaatttgaggcaacagaggaatgagtgaaaacaactaatgaaaaggaaaagataaaattctaagcatttggttccatcacttagttactggtgtcccagatcaatggttcctctcctttgaccccagcgactgaaaagtgggcgactcctctagatgaagcaagaattttaagcaggaatatagggttaggggagagagatttgaatcagcaaaagtttggaggccctgcctatcccagataacaaaaagcaaactcatgtatttttcattgctatgatgacacttcccttctgagttgatcttcatataacctctgtttgtgtacagttccctaggtgtctttcatttttcaaagcaatttcaatgtacattcaatagcttctcatttaattccaagaaattaacttaccttagagtattgctttgagtcatcagatcctagaagctctttcttttgttttcgccaagtcacatttctttctgtctttcagttgagttactgagctattcaggctatatctttcataaaacttcccagctactcaacaagatgaattcagggtactgaagcacagacttattatgtaaaaccagtttcgacatagctgtgctacttaacattctgtccaaaggcagactgcaccagagaaataatgtgcttctttcccagtgaaatttaattgggtcatttgaaccctcaaaatcaaatagttacacaagaaattacaagatctctgtccattctacgtaaaagacaattgcctagagtcttggacattggataagcataacagttcaacataatgttggtgaaagatctaagtgttgaccttgaagaggcagctccaagaactaccctagataaaagatgcttgtttcctcttttagtttaaccacaagacccatgctttcactgcagagccacactatgacagggaatttaaaacatgaacccatatgtctgagactgcttctgttctgcagaagctgagagagcactagactggaggaattttaaaccttaaggaattttccaagtgctagattgagatgttcagtgtctttttcaattttggcatggtgacaatggaaaatctctatatgaaataataatgaatccataacaaatatgattggtagacaagcacaccatcaggaggataataatctttcagcttcactcaatgaaactttgatgctaaaaatcattactttgataatattgccctcagaatagaatagctacctgctgctaatgttcagtaatatttggcttagaaaaagtgtgctaagttaacttctgtgatttttttttttccaaaatgagagaattacttaaaggggccaaatgctgtcaatgattacatttccattgtagattgaaggaggagattgtactgtgcaaacaatttgataacagggtatctaaaattttacatctaattttcaaataaagttttataggaaaaaaattatctatcagtcacttaaatgcaaataccaccagagtgttctataggtatttgtatatattagataattagcattaataaatcaataaattataattgctttaatattactatgaaatttctttagtttaaaatataatttttaagaaacaaaaaatagaatatttggatccacataaaatgtatttgattggtttagctgaattaataagtaagttcaatcaagcctatggtaagctcaaatggcattttgaccagctgtttttctgagttgctgtaattatgcctacagactgagcaatgaaggagactgattttggctttaacattgcaatgcattagcttaagacaaaattagaaactaatatttgtctttcacaagtgatgatctcacaatgtgaaagagaacaaagatctgcagctggtaaaatttaaggtctcactgttcgaatttttaaatgaatagactaccacagacgaataatacttgtccaaagtcactactatcacgatgtataagagacagaatttatgacgttgagttagcagcagatgtaaaacagaatgtatcttctttgctttttgtcttttctgtagttttggatggtactcattatgtgcataactaacactgtttactgtatgcttctgtctgatcaagtgcatgtttttttaaaaagttactgtttgcctgcctaaagttaaatgttataaatttaaacatgttcatgtaatttatcagtttgttgagcatgtgttcacaccctgtcacatgattatttcctctactcagaatgctgcttacaaacacaatacagttaaccttggcatgctgccctatggaggtatttcagcaatgcatgcaggcagaagcatgactttaaacttgcagactaagtctaaatttgatcatcaagaactacctcttcagaaagtaagtatggactgccctacatgtgtcagcataccaaagccaattaatgttgtttgttcacttaatgtgtttaggctatacatacaaccctgcttactataggctcctatgagtccaaaaagcacaagggcaagtaatgtagagcctgaactcttagccgctaaatgaatatttgtagctggactgattatcaggttcctgctttttggattgagctttgctttttggattgagcaggtacatggctttttgtgttgcttcaaggttcatttttcttattattcatttccttttttcctcctttgtttttctttattttgtgtttatatatatgttttttacttttttggagatagtcctatcgtcctggtgatgcattctgagaacagagctcaaaattattgttggatttcaactgattcttttggaaaagacatagattcctaaattaggagaattaagtagctggtacttataagtgcttcttcagcccatttttttgcaggaactgtaacagaagaaaaatatgagaaacaagtttgtggcttaggaaactaggttagtggaaaagtagcaagtttgcatggtattagatgaaaatgtgggaacactgaaagggaatatactgaaagaggaaacatttccattgttaaaggaaaatttctgtttgtttaattcagccaaaactgagaatgcacattttacatttagatcgattaatgccttctgtcttagttacattttagtggaaaccaatgagtcattttcacagtatgtcattatgcctatatatttatattgtcattagcctagtaagtttttatgaaaaagcagtgcaaagtagggataatagaatgacagtaacttctaaacacttcttccctcttaataaaatgaatgaacattatgactcaccccatcaaaatgagggtcataagacctcaaattcctgttttattgttaatctagttttttaataacattcccaaactgtggacagtttggttcatactgtgagtagaataacaaaatcaagaagacatttgtagccacagcttttttatcactcaccgtaactttaaaaaaaaaaacactaaattgaaaacttttgaatgttgtttttgctgtgcccggtctatactgcaggaccagtggagtgctggtaactttctctccaaggagaaagacaaggccttgatttgtggtatctgccaatgtcagcaatataaatactctccctatggctaatttcaaggtaccaacttaatgtgactgaacttagaattgggaagattcacgtgcagttgactctcatgagccaatacaaattggctccaacacaccatcagcatgactatttttacttgagttcctactttaatgaaacctgttcttcatgtcctctcggatgcccaagactctcatcctcttccctaaaacaaaaccagttttcaaaaagaccttgaaacttaactgcattaaggaatagatgagatatcacaactttaaataggcacctttcttatagggcttgctaattaaatagaaatcaaaccttgtattagtctgctctcacactgctaataaagacatacccaagactgggtaatttgtaaaggaaacaggtttaattgacttacagttccacatggctgggggagcctcactatcatggtggaaggcgaaggaggagcaaagtcacatcttacatggcagcaggcaagattgcttgtgcaggggaactcccatttataaaaccatcagatctcatgagacttattcattaccatgagaacagtatggaggaaactgcccccatgattcaattgtctccacctggccccacccttgacacatatggattattacaattcaaggtgatagttggatgggaatacagccaaaccatatcaaacctttaaactaaaaaaattgaatttcaaaattcagtgaacaaattaaagagatcttggcatgatggaagctattgcctgaacccccctgaagttatatcatatgaagatgcccctatttggcttaatttttggccatatttacttatcaatctgtatgacaatatagatatatacagtatctgaaaatgccaatacacttgaaacaatgtttcctaacatctaaattactctccagatataaattagatatcactgtattagcatattaatttcctgatgtcatttggggtaccctagagaatggactcactattactgcgagctctaagaagaaataatacagagttatatttggggactttcaatagtcctcagttgagcacagagatgaccaaaacgaattctctttggaagctacattaattgcaaatcaagaatcattcaagtattgaaagactccacctcaaaataaattatcgtcaatattttattatctgcaccaaaaaaagaagaaaagtagagaaggcaagggaggaaaaagatacataagcagggcaagtaatgcattactccaaaagattttatgatccaaaacttaccactttaagtcctataaactttaagcatttaggcatctgggacagctttcccaccccatcaccaatgcaggaaccttatcaggcactggatagttaatcagctgcaataatagctctgggttctgcttcctcccacgaattccagtctaagcttctgtcccttcacttttgtaccctgatacgtctcttgtacagagctttcatttgaaaatttgttaggtttttctgccacactctagagtcaaactctctttaaaatgcagtctctccaattattcctcctgggcgccactgaccattgctaacaggtcccatgattgaggttcaatttccctgaacccttctccccaggagaggagataggcaaaaattacttaactttgatttagaaatgcataaaaatctgttataacatgtttatctttctacttaagatagtaaaaattaccatctcaggtccttaagacttctttgcagcccctaaatactcattagccataagaactgtactaaaatatagggtaagaccaatttttaaacaaacattttcagcaaataaaattgacataaatgtttcttctcctgtggaaattctgaagctgtctcttttattcataaaattattgaatgataatactagctatctctagttagatgctgtggcaagtgactctggggtgtcctagaaagaatgaaggaagtttcctaaggaatctgttttcacctgttagaatttaagcactggaaatggagttgtagtatccatttgtgcaggtgctgctctccgaaggaaacatgtatccccaccctctctgtttgccaaggcttgcctcttgcaactaggacaaagaagaaacttttttatatttcttgtcctgcaccaaggctgtctttaaacaaatttgtaataaactaattaaaggatataattatttgtgaatgaagcttgaagaactctgcacttgataaactatttacatagtgaatatttatatgaacaaaaagggagcactcttcaagattttgcaatgtattttaaatatttttcattttttcatatttattacatgtcagatcaagtatggtatatttttcatgtattacaagctaaatataggctttctatactataaagagtaaattacatcttctataattttatagaactctttcagatattaagaaaatgccaacaaatataacaaaattagtttaataaatttaatttccttaatatattcatttatttagatgcttatgctaatttcccagaaaatttagtaatacttaggaaccagaacatttagaacatataaatcttttattaaattatagaattattagtattttctattgattttttattcattcattcagtcattcatttattcatctatcatttatttactgcctttccaaaaagcatataaggcaactttctatgatgttactaatggttccatgtgcttctttggatgtgttttatttgtaattaagcttagctatcgtcttgaaattttatgttgtcatagagaaatacaaattgtaaaatgctagttcaaaccagcatttttaatatcaaaattaatggtagaatggatagatatttccactgggagaataataaagacaaggatttattgagaatctactatgtacctggtgctatgaggtactttaactatattttgtcttgcaactcataaaaccctcaaagtacatatttatctccattgtatagatgaggaaactgaggctcatgtgttacaccaaagaactcacctgtattgtcactgtttcactgtcataactcctgcacttagcatagtagtaggtagaatttaaatctgcttctgcctggtgcccacatacatactctttctactctatgatgatgctttctcaaatgtttgtaaaacctaacattttcatagaacatgactcataggttaaaaacctcttccatacacattattacctcacatcatcttcaaaataatctagagaagtagatattataggatggagaaaagaatacacaagtagaatatattaactaatccaaaacatatcatgaccccaatcatgccctgtgtgctacaggttagtgctttcttagttagctgagtttaatgaatgccagtaattatcttgtgctttttcagatccacttgcgtttcctgagcactcagtatcaccaagaattatttttggtagcagtgaaaggcttaaggttatggatccaagaaaataactcattaatcatccaggctactgcagccctagacacaagcagggctggggagaaaatcattggcctttcctatccccatgtctgcaagtggctggctgctaatataaatagtgtggtctcttctataatggataaattgataattttctcttgttcattttttaatttctaccaccataacagcataccatagcatccactgctagttggcttattgaattaggcattaatataaattaattataatttcaggtgagggaaggctaaaatagtagaaatatatgtaataaattatcttatcatagaattttgcatggaagaaattggcctcactatctgttttactaaagttgattgaaattagttagttgatattcatcctaccagattttgagttagagaaatttagatagcaatatttgcacctaaactatttttaaatgtctaatgtcctttctttctggatatatgcaaatgactcagtatcagatagtaccaacatttggtatgcatttattcaccctagtgccaagacttagtggcttatttaatgcagtttttttctgctgaaagcaaagcaagatttacgctgcacctcagggcaactcatgcctataatttctattgattctgctgcatttattattggctacctgtccctcaagaaagattcacttacctttctaattatgaaaaaagctttcagcctataaatccaaataaattcttatagacagtgactaaatttaccaaaataataatttagtactcatgtggaatttcgttataatggaattctggtttaaaaataacttgggcattatattaccaccttcagattgaagcctatgaaatcactgtcatttagatccaggcttggcatatttttacctttgtaatacctattttttccaaaagataagatggaaatgaataatataacaataatttcactggaaaaactttgggggagattgtttttaacaatttttactgcagatttttgaatctgtggtaatgtcctttatgaaccatgtgccaattatttagcaaaagagatccttgtattcttaagagatatgccctgagacctttgcaaattgccaaattctaataccactctcatataattgtaataataagtgtgatttcacaagcatactgtacacccatcaattagcaaagctgctgtaccatctaagcttatttaactcacttatgtgactactgtgcacacacatgtttatacacacatatatacataagaacacacatgcatgcacttactcatacaaatgtgccgacatatatagatatagagaaagaggcatacatatgcatgcacgtttatgtctcagcaaaattagaaattacttgatcaaatagacacttgtgatcattcatagcagtcaaaattacgaatgttaaatccacaaatacccacactcatctttgggcatagcatttgttccacaagacttctactcagcattattgcatgtcttatcaaatacaatttctgatttttcactaaatcacaccagccatcttctgtattattttgaaatatttaaagacctgcagaatttagaagctaaggaaatagtgcattgtgatgattttctgtgttattatatttagttatatatgatgaggaaaataaaactcattcttactccttaaaatatccaaagaaaatatcaagaatgtggtgcaaaaaaataattgaattaatagctgaacctcagttcaattattttctctggaatattaaatttcaacagtgatagcttcatttttttaacatttttcagtagctccttttagcctttaatagaattttaactgctgagctactcaatttatatacaatagctatactcctttgggaaagaatatgcacatgattctctttttggtctgcaccaccacaaccaccaccatcaccaaatgtcaataaattgtttttaatgatctttctatttctgcagacttaagccatccctaaggtgtctcatgcaagaaaaacaaaaaggccagagtattcttaaaaggaaattgctttcaggaatttcctttaattttgctacctagtgaaagtatctttttaatgtgtctgcatgtttatgttccttttggcccctgtaatagagacttggtgtgattgttaattctaattttgaaaagaactagattaatttataaactagtgaagcacctacaccattatattaggattttgactaaaaggatttcacattttttaacaccaaaaagaatttgtaattctcagtttctctgtaactggaaacatgtctgggtggaggaaatacagatagagttggggaggatgtggagaaaaaggaaacctatgttaaattgtggccacttcttaaaaatctacattgcacagacctggccaaatgaacatactaattatcccacttcactagcaaacaaactaagtcagaaaagataaatactaaaaattcaaaaagaaaaccctggccagtaatgcttaacctgaataattatgttttaactcttaattttaatttttatttaccatattttaatatctagaaaaaattgtgtatgggcatatgtaaacatattaatctggaaaaggtaaacactagaaaagtgatgctggaaaacagacagtcgttgaatagctacctgctaattttgaagtaacacatactttaaacatgttgtctagattgaatttttcaaataaacacacaccaattcattcctaactcaggagcttaaattcagtaccttttttctcttttttttttcatactttttgataggcttatgaaaaaagaattcacataaccaaagaacaagaagaaaactgagttaattttcattatatccattagatcctaggaagacttcatctagtgtcatattaaatcctattttagaatttttccaagcaatgcctttaaaaaaatgcttgtggttagaatgcaggtaaggaggttctatcattgtttttcagaagagaacaaactaagaccactcaatataaccagataaagcttagcaaacgcccatttttaacatgttttgatgagaatagcccagttctccctttctaggtagggtaggaggacaattccttacacaaaatatagctgcacactctctagctgggctttatcagtagggatcctttagaacatgtgcagaaaatggcataggaaacactggagtataatagctcaaccacagaagaattccctcaggaaaccaagcagtacttgtgtatcttacacactagggaagaaaggagcctttgtgaaaatatatgtaaatataccattgtacatccctccactggaggctttctgatggtatgtgattgcttgctattactaaggttagaatatgaaattcacccaaaataaagacaggcaggtattagtatttgttaaaaataataagcatgaaatcagccaaaataaaatatttatgacgagtttaaattttaatatatatcatttatataaataaataaatttggtaatcaaaacagtcatgatttacttacactacgattctaatagcacatttttaatagcatatttttgatgtccccccaaagctatttgttgataacgccatagtaccataaatcttgcactatgccagtgttagcactatttgggtttagtgcaaggcatattctcccagaatcaatacaaccttataaaatttattttaggttatggcttagaatattagaacttatattctatgtattgtatggtttcaatttctattctaaatggtgagattatactaaaattaagcaagttttaagtgctgtgtttttaataattgtaacaattggttaattttattctgattatttttattcaggtactgtaaataatctaaatttttccttaaaattcagtgaacaactctaagatggttattttaattgcatttttcattgcttccaaaaagctttcaatttacagttcttacccagtaaatagtatataatatttgcagttcaggatgtatgtttttctgcaattaaacaaaattaattttaccatgatcattagggactcttttcagaaaactatggtaaacttctactacatcactaaagaatgccataccatttttgcaatagaccccgtcccagcaaagcaacattttagacaatggacaagaagatgtatctcctagtggccaatggaatccttatccacttgggaggcgggatgtacctccggacaccattactaagaaggtaaccaatttttaattaacaagacaaaccatgaaccttgcacaatctactgcaatatataataaatattttgtgtcttatcataatttctaagtttgtgataactttaaggtaaatattatgctactacacgagtttggttgactgtaagtacattgaaatgaatggaaaataaacactgccaactgttcaaagttggtaatgaatgtttacaaacaacatcctgcaacctctctacagatactcttacctcttaccacccacctttgaaaggcacatatagaatgatatgtgacatacttccgactctcttggctttaacagtgtgttgtaaccagtttgcttaaaagaaaatttgattcactatttctaaagttatgacaattgattcagcaaacagtgaacaactatatgtacattgctatgtgtggagcacttgctagatattgaggaaacaaaaatgaaaaagacagtttcttacttcaagagcctttttatctagtaaggtgtgctgagtgataagtaggtaattataatattacataacagatccccacaacaggagtaaaaagaaagccacaacttgggataagatacttgccacatatatgagagaagggagaatttgtattctaaaatatattttttaaagctcttacaaatcagtaatgaagacatacaacacagttttttaaactggtaaaatacaaggggaatcaggtgggtaaataaatactaaaacaaaactgaacctttttatcaatcagggaaatgcaaaagatatgccatttacatttactagactggcaaaaattaagaaatctgaaaaatacaagtcgtttgtaggtataagagcaatggaaactcttttagacttcttattggaatatgaaacattatcactttggtaacaaattttcctgcaaagctgaatatgcacatactcgacattccatcaattctcctcttaaggtattaaactagaaaaattatcatacatgtcattcagggtacttgaaatgtttccaataccagaaaactgggaaaagccaaatgtttaccaccaggagagtatgtaaataaattctgttaattacacaaaggaatatttcaaagcaataaaaattagtaaactataattacaataatgtgtattaactttagaaacataatttgaatggaagaaaaagtttctggaaatggcatacatatgtaataccatgtttacaaatcccaaaacaagcaaaactcaaaatatattatttaagcataagtacataagaaacctattgttataagtaaatggtaaatgtagtattcagaattgtggttatctctaaaggtaaagtaggggatggaatcagggagaaagtggatattattgctggaactgttctaattctgaaattgaattatggttctttacactctactttttttttttttttttttttttttttttttgagacggagtcttgctctgtcgcctaggctggagcgcagtggcgcgatctctgctcacttgctcactgcaatctccacctcccaggttcacgccattctcctgcctcagcctcccgagtagctgggactacaggggcctgccaccatgcctggccaatttttagtagagacagggtttcaccgtgttagccaggatggtgtagatctcctgacctcctgatccacccgcctcagcctcccaaagtgctgggtttacaggcatgaaccaccgctcccggcctacactctactttctaagctcatgagtgttcattttataattgtgctttgtaacctacatatgtattacatacttacactctttgttacttaagtgatttttctcttgatgaccacttcaatacttcaaaaatgcattaaatatcaaattttattttatccaaaatatttggtaatgccactgatttacaggcatttattttatgcatgttattaatttgactattgggtaatattcagcaccacaggtaaatataatatgatgtggttaatgctaagatgggatacagggctatgacagtacctggaaagggcacctgtttagcgaggaaactaagagcagtggtgtcaaataagactagagggataagcagaagccggatcatgctgggatttatcctgtgggaaatgagaaggggaatataaagtattttaaacagagaaaggacatgatcaagtttttatttaaagagcactctgacagcttttcagagaatgaattagtgaggagaaagactggacgcaatggaactagttaggaagattctatagtaattcaggtgaaagtcaatggaaacaatgggtggtggaaagatatgctgtattagtccattctcacattgctataaagaactacctgagactgggtaatttatagagaaaagaggtttaattgactcacagttcctcaggctgtataggaggtatagctaggaaggcctcaggaaacttacaatcattgtggaagcaaaggggaagcaagcatgtcttcacgtgatggtaggacagaaagtgagaagggggaagtgctatatacctttaaacaaccagatctcataagaaccccatcacaagaacagcaagaggaaaatccactcccgtgattcaaacacctcccactaggtccctccttcaacacttggggattacaattcaacatgacatttgggtagggacacagagccaaaccataacaaattcatagatccaatatcatgataaatattagaaccaaaacaatcttgtgattggacatagggcatagagatagataaaagttccaaggttgatacccaagcttctaatgtggtcaagtgagtgatgatgttccattcactaagatgggaaatacagaaagagtaataggtggaattggaggaagagagaagagtttaggtttttacatgttgatttgaggtagctttaaggcatccgagtggaaatgtgcagtggatgtttggatatatttatcctaagttcagtagagaaaacttagctggagattcaaatttaggaatcattagaacatgtattattgagccatgagtgaggtagaaggatggcccagaactccatggaacagaactccatggaacaccaacatttaagacatgtacagtacataggaagaataggcagaaaagaaataatcaaagattagatcaatacagcgattttactgcaagctgtagaaaattcaagggaaacgttgaacttcaaggaaatacttcactaaacataagaagtagttgagatttatactatgcctcaactttagtacttggttctctcttattaaatacttagcgttttattttcccattccactctgccctcacgctgttggctctatcctaaaactggtttctctcataattataagattactaccaatggcgattggtaatatgaacttcctctttcaaatccagcaagagagagaagtaagcttctattgtagctctctcttatgtgcaaaacctttcttccctgagtctttcaacaagcctcatcttacatctcattgacccaaaagagctaaggacttcccatcctagaaaaagaaacggagttatatgactggctttgtctgatcagttggcgtagagtagacagggctctcaatttcaattatgcaagaaacatgtaaaggaaaaacaagggaaagtaacactttggaaatagtgagggaaaaatgttttaaggagggaacggtcaactgtcaaatgatgcacagaaacgtcaagcaagataagtatgactaaaggctccttggatttagcaacaaggaggtcattggtgatctcagcaaaagcaatttgcttaaatgttggggggggaatccataggaatctgcattaaggggtaagtaaagaaacctgtaaaactcaagaaagaagtaatgtactaaatgtaccatgtcttcttcctactattatgataagcaggttctgattatcccatattatagcaattttgcctaaaatccgagatttctgaacctataaatagatatgtccacctatcacctctcagagtagagagaataaggaccactttaaatattcaaatttagtttttgttatatattatatattagttgaatagtcaagttaatattcagtgagactcaacctaaggaaagaaaaatggtcatgggagtattagcctgggctgcaaaatttactgaaatagatgcgataattatactattagttattgggtttctatttgattctacaatgacatttttaaaagttaatattatttttgcagttgtcacggagtgagcagttaggctagacataatgggaatggaaagatagaaagtgaactataaattgaatggggaatcaaaggagaataagtggtgaagaattcttagccagtgtccaatttgagtctatttctccaagcctctgtagattttttttttttaatcttgtctctctaactaagccatcagaaaccacagtaatgctgtagggatttggagggaaattatggaaagtctttgactgaacttgtggctctctgttctggctatcatagatttttggttactcatggccatgccagccagtacttcaagcactatagagaacaaatgtgggtgtcttccaagctgtggatccaaaaccttagacacataaagtaattggacaagaagtgtttatttctcagaattttgctcctgtatctattgtccctgtcctgtgcacctgagagtggcaaagtgatggaaaaatgccaagagtgttaaatgctgtctttttttttttaagggagtaaaagtaggtggtagattttatttctctcttgctatgcagtcccagactcacaatttttttttttttttttggcagagtcttgctctgtcacccaggctggagtgcaatggtgtgatctcggctcattgcagcctccccatcctgggttcaagtgattcgcgcgcctcaccctcccaagtagctgggattgcaggcattcaccaccacgcctggctaatttttgtatttttagtagagacaggattttgccatgttggccagcctagtctgaaactcctgacctcaagtgatctgcccacctcagcttcccaaagtgctgggattataggcgagagccactgtgcccggcccaaaatctcaaattttgatgtctattagtattaaaagtttaggattcactgctagaagaacattttatagctatgtaaatctgacaccccaaaattccaggcagtattatatgaatactttaagaactgctgtttaaaacttttgcaattgctgaaaacaaccatggtttcagaaggagaatttgtattttagagtctaattacatcacttctgttactcctacagtctatcggattatgccacagtcactatagtcagaatatttggtttcatgtattaaatctttacataaggcattgtgttaaatgctttaatgtatttctttatctaactttcacagcaactatatgaagtaagcactattattttgttaaagaagaaactcatactcagaggttaggttacttgccaagctcacctgggtaacttatcattttatatttccctcctatatgtaacagaaaataatatgaaggtgatactataaaagataaatgcaaaaacatgttattttaaattcagacattgcactctgatttggtcaaatcctctatagggatgacaaggctgttttgccctaattctaaaatgatactcttttaaaagtattaggagtcttaaacacattgaatatccataaaatgttaaattaaaggataatatctgcaagagtatgttagaatgatggagcagaaaaacattgcagccaaaaggctacagtgacatattaaaaccaatgaaaccaaacacttcgcttctggaatggataaccaagaaactataaaatcctagcattttaaaatctgaaaattctttagtaacaaaagactaggcattcaaaggtctcctttagcatcagtgactctttccaccctgagtgtctgttccctccctgagtgttctaggttaagtgcataatgacttggcagttggagtaataaagatggataacaagggtcaatatcaggatggacacagaggaagaggaaggctttaaaaatttgctgattagttttggctcacaaacttacctcttatgctgaacttgcctgtgattttctcacatctacaatatcagttcagctattaagcacttcaggattgccaggattgtcatctctgagacatgcctaggaatttatcagaagaagaaactagaagaaagtgtgtgtgtgtgtgtgtgtgtgtgtgtgtgtgtgtgtgtgtggtcattttcaagttcttattattcttcctttaccccacccccaccccaaccccaaattgtcatttttgctttttctaaaatacttttttaaagatttttttattaagtttctcaggaggaatattcatttcttatttcaattatggcatttgtcatgttttttaatgtaatacatttcaatgcttctttctataaaaatttagaaaggtaagatctaaaatatcttttgaaaatcataaattgtttttctgtcaaccatatggccaaatcatcatttgtgctttaaaataactggatcaaattcctactgggattttacttggtaatataagtcagtctattataaaaacttttcagaagatcagagtaaaccaatgtcatttaaaataagtacaacttatttaaaagatatttaaaagtacaacttaagaaaaatcacctcaacctatatatctagaaatttaaataaatacattttattattttataaatatctaaaatagataattatgtccagttgtggtggctcacacctgtattcccagcacttagcactttgggaggccgaggcaagcggatcacttgaggccaggagtttgagaccagcctggccaacaaggcaaaaccctgtctctactttaaaaatgtcaaaaaaaattagccaggtgtggtggtgtgcgtctgtagtcccagctactggggaggatgaggcatgagaatcacttgaacccagtaagtggaggttgcagtgagcagagatcatgccactgcactccagcctaggtgacaagagcaaaactccaaccccacccccccaaaaaaaaatcattaaattacagtcactgaaaagtaaatttattgaaattgttttccactgaaaagaaatattgctatcagtactctgtgtatgtagaactggaataaaagtaactataatttttggttttgtaatttaactgagaataggcattgtgctgttgaggtcccttatgtcaaaaggttggggtgaatgtagcttatttaaatagaaatagaagaaagtctgaaatagatgagagagagagatgaggatttaaatattggaaaaaaatagatggcagaaagtagagtagatcatgaggctgtaagcaagcaagtcaagatgtggaagaagcagatatgaaaatcaaccaggtaaatattacatataagagatgcggaaatagaattgtttcttatttccgttaacctcaaagtcaagaatatctgttctggtttagagtaaaattgaaattgaaaaatgattctaaaacctgagtgattgtcaatgctgtaactaaattctccttttgtacagaagcaaatatatcaagtagaattgttttttgccttaggctttgtattttttccctcccaaagaaatgcatgttgttaacagtgaagaacccccaggagttatgtctttacttcattggtccataagcaaatgagaacaatcttctccatcactgggagtaataccagtctcaatcatcacttctctttcctggttctctttcccaagcctcataagcaaatgagaacaatcttctccatcactgggagtaattaataccagtctcaatcatcacttctctttcctggttctctttcccaagcctcatttttctcctccgagagtagcaaagttttcactgatcagagttaatgttgtttctggtagactaggcagtccctaaaactcagaaacaaattggagttcctttcagagagtcattctcaattccaaacagctttctaaatgctaggaaaagggatcttttgagtcattagatagatggagattctctgtttccctcatcttgttcccctaccctccttttggtggtgtcacttagaactttgtgtcaagcagtataaaggctgcattggtttctgtggtaacagcatattatgctgaggctgctgaggaaaagtagcttcaagagacagcagccaaatgcattcactgtcagtaagctctgcccagaaacaagaaatgagttcagtgaaaggccagattgattaaatcatataattataatttttaatttaaaaaatgtttggcacaatctgtagcccctggagagacatttcttaaacagaaattatgcagtttttctcttgaccaaaagccatttttttcaggacataaaaaagtggaaaagtaggaagatatcaaatgtgtccaaataaaaagagccttcatctccagtgagactttgaaaattacctctagatctacggaaatgcaaccatactttccttggagttttggtatctactagaaataacctagaactgaattatttgtgtgactaataagtacctactctttaatttcacctctggttgaaaaggaacttttaaatagtagttacaatcatgccggtcacctgagaggcagtcaaccactgtcacacaaacatcctccaagttaggacaggttaggagaaggagaggtaggtagatgaaaattataccttatagaacttttgattagtggtcatttactgacaacattgtcaggcacctaccaaacaccaataggaggcttttgagatttctgatgcttatatttagtgatatattagtgatatattaagacacccctttactttccctgcctatcaaatctatgcctgtatccctactaaacttgttttggtatggtctttatggcagtaacattagttattgctctggaacagaataaaaatgcactgttgaggttgtaaaaattgtattgtgcagaacaatccaaagaacaattatatgaatatctgcaggctcaaatcaagttgcactccttttacgtaactttgccagtaatcttattcaggtgaattccatatactcttttaaaacatatgctaatttatatattatcatattatttttttccagaaaatcaatagagccatgccttttgctatacttgggaaaataagactaaatacgtccaattacagttactgtccccctaactgcaaattattgatataagatagagatggtatatacatatgtagacttgcttgttaagaattatcagccaatgccaaataaaccaaagtacatgacctggaggaaatcaaaaattccatggaaataagacctttcagaggcagctccatgacttagtaatagaagctgaatcaggaaaaagggtttgaaaaaatcaatgaaataatttatttaatgatccatttcaaatatgtattttgttaatctgaagagctaggataatatatttctaattgattgattttagtattatttaattcataggtgtttttaaagcttactctatttctattgttattagatttgttctcagaaataatggggataggaggttgtgaaaatgtgaatggaaaaaaaatctctaacctaaagcaaaaatgacagctgaataaaatattgtttaatttacagtcacttttgtattggatttttcttaagacaacattattctttaactcacaaagcatacctttatttcctaataccagtacaacaatacaactgtctgcagtattgaaggacatcactgtcacaaaatcggggattgtcctcatccagtctcactctaaattatttccttaataaaagtgtaaagccaaaaatgtctgtcaaaaagctatcaagtcagaggtagaaaataaatttgccacagattaagcaataggaaaacgggcagattaaagtacttactccatcaatatttgacatagatgttccttaaaacaaatgactgttcttcagaaaattgagataactcaatagcatttatattgtctttgtttggggagaaatctaaaagcaaaaatgcagaattaatccaatgccataaaaatgttccgggttgaatatgtgatgagaagtgatgattgagactggtattactcccagtgatggagaagattgttctcatttgcttatggaccaatgaagtaaagacataactcctgggggttcttcactgttaacttgaagttctacataacatgacagctggcagagatcaaggatagttgccagatagagatgtcaaaatgataagattccatttcttgccacttgatctttgtctgacttactctactagctgtaggttcttagaaatcttaagggtgaaataaattgttgtcaaacttttatcgttactcttaacatcttccattttgggaatatatgtcagcatcatcacaaaacaaaccataggttgaaaagtgtagactcatcctcagtttcatcattctgctattaaggatactccatcgttttttaattttggctaataatttcctaaatccatagctatgttttgttggttgacatttaatcataggagaatgtacttatagagattcaatatgccagagatgactgcctttgtatatcagccagctgctatgctaagacacttacactgaagtgaaaggttctaccacctcactttttatgtgtcattggagacactgaagtatattaccagtatctgactccaaaaaattcaaggtcagcaaatattttgaatgccctctaaaattactgcagtgtgccaccagaatgaaatgtcaccaaaaccccaggacaggagaaggaacatcttcctgccccctttatttttagctgcagagcttccttccatatatttgtgcaagtttgtcttctgacactgaaatgggagaacatagattttggcatcaagctggcctaaatacaaataaaacaggatgaaaaggttcagcttaataggttgttataatcagaaaaagaatatctacagtacatacagtaggcactgtactaagatgcttaccttgcaaaacactctcatatcatcttcacaactttatgggaccaggagttagaggtatgaaattgagcgatacaggattggaatccagtgttgtctgggtatacagcctactctacccactaattattcccctcatatattttatcacacacacccctcccaacaaaaaaaatcagaaaacattatagcatagcccattgcactgttaaataacctcaacaccaggaatatatttgatatatatatagctagtactttttggcactgcttggtattttgttgttgttgttgttgttgttgttgttgttacattttcaaaagagagaaactcatgcactagtcacattttttaaagaattttttagtcctcttcaatttgtttttattggtctatgcaaatcaaaatttttagagattttgaaatgcatctgttttccaaaccttcatgttctttaatatgaaacatttacaagttctttagtgacctttgtgaatctcagaacaaaaagaattaggagcactaagcacaacttaaactttaaaagttctcttaagcactagaggccttttcttcatattgaatttagttcattttgttaattttgtttctcaataacatagtacatcaaacttcttgagtatattctctgcaatttctgttaacccttcttggttgatgctgtcaccgttttccacaaaataacctgagtcctgtcaccaaaactacctgtgaaaatgatacaactgcactgaatattgacacgtccagcaaaatgataattacactaatacagggtaccttgcataggtgatacactaaactatgtagtaaactgtaatacgaaaaaaactcagcttttcttttagttcttactaagatcttgtcttttgtttccttttaagcaaaagttcaggagaaatgttcaccttaactttgtctttattggcccttgagcatattaaactttgcttctcagttttcccatctaagaggaaaggatgatgatgcttatcttatagagtggctttgaaaattaaccatgattatgatgtaaaatacttatcacagtgcctgttatgtaagtgtttaattaatggtagctatcataatatttattattttggataaaaatctatgtgaattatggataagctaactttcatttagctttgttcctaacaataggttgttaatgagaccaaagtcatgagttagcatctctttgaattagttatccatgaatacagactcctctctttacctagatggttgtattaaaaacatatacaatgatggggatggaaatatctaggggtgaaaaaacaaagatgaatcacagcaacctaaaatattagtcatgttaatagtgcagagtaagtagtatcatcttgacttatggcagaatgtatttagtccgttattgtatattctgtccccatccataaaagaggccacatctcaacatctgaaacaaaatgcataatttactgcttgcatacaaataacttgcaaggtacaaccactctgagctaaataggatttgaagaagcaaggagttgagtgactggtggatgttcagaagttagaatatttaggagttagttggcaaaactttcattgggagaagcatggttacttgactcagactgttgctgactggttgaccttcaagtgcagtttctaaagcaagttgttactgattgattacaacaggtttaaaatcatttttttccagtggttatttattgctatggccagacagttagaccttcactctgcagataggaacttttgttctcattgccattagagtgctatatctccagcaatacactcagtgtattgcattatcttctttaatcttcaccactttctcttaagcactaattattatatctgcattttcatctgataagcagaaatcttaggtaccttgcataagattgcataactaaaaagtgacaaagcaaggaataaaactcaggttcatttgactccaaagactatgttatctgtactgcatgtataattattttttaattaactcctggcatttctataacccccttcatttatttaattttgccatttcaagaatgctatgtaaatagggtctgtatgtatgtaaccttttgggattggcttttccagcatacttctctggagattcattcaggtgttgtatgtatcaatagttctttcctttttattgctgcatagtattccatagtatggatatatcacagttcgtttatcatttacctatggaaggatatctgggttattttccatctatggctactatgaagaaaattgctataaacatctgtgcgcacctttttgtgtgaacctaagtcttcataagtctctgggatgaatgtccaggaatacaactgctggatcatatggtacttgcatgttcaatttgtaaagaaactaccaaacatttttccagagtggctctaccatttgacattgccagcagcaatatgtgagtaatttagtttttcttcatcatctcctgcatttggtgttggcactgtgttttgtcttagtcattctgttaggtgtgtagtgatatatacacttactgaaaattaactcagattatgaggtgaattatgcaaacattgtggttttaatttcaatttccataatgactaataacgttgaacatctttttatgtacttatttgcctccatctgtatatcctctttggtaaaatgtctcttcgcatcttttgcccatgttctaaatggattgtttagctttttaccattgagcttgagagttgagagttctttatatattctaggtactatcctctatcagatacatgatttacaaacattttctccaactctgtagcttgacttttttttcattcttttagcatttaacatttaagtctgtgatctattttgagttaattttgatataagatttgagacataagtcaaagttcatttattgtgcttgtggatgtcaaactgggccagcaccatctgttgcaaagattctttcctacattaaattgcatttgcatctttgtctcaaatcatttggacatatttttgtcaatctatttatcagttctctgctctatttcattagtctatgtgtctatccctctgcaaatacagtaacacatggtctttcttgattacaactctaataaacttcaaatcagatagactgattcctctcactctatacttcttttccaaacttgttttagctattctagattcattgtctttctgaattttaggataatcatatgtatttagagataaatcttgctagaattttgataagaattaaactggtatatcaatttggagaggatctttactttttaagtctttcattccataagtatagtctgtctctccacttatttaaatcttcttggatatcttcatcagcatgtaagtatagttttcagcttataagttttatacaagctttgcttaatttgtacctaagtattgcattttttgaatgattatacatggtattgcattttaaattttggtgtccatgtgttcattgctagcatacataaatacacttgatttgtgtatgtttatcttgtatcccatgaccttgctaaactcactcattagttttagattttttggttgttgattcttttgaattttctatctagacagtgtcatcgtaaataagaacagcttcttttttcttttcaatcttcatgcattttacttccttttcttccattatttcactgactacaactttcagcactatgctgaataagagtagtgagagtgtacatttacgtctgctcctgatcttagtggtaaagcatttggttttttcccattaagtatattagctatacatttttgtagatgttctttattgagtagaggaagtttccctctattcctatttctctgaacactttcatcatgaatggatgttgaattttgtcaaatacttcttctgcttccattgatatgatcacgatttttcttctgtagcccattcatatggtgcattacactgattgattttcaaatattgaacaagctttgtatcactagaataaacatctcttggtcatggtatatcattctttttatatattgctaaattttcattgccaatattttattaaggatttgtgcatctatattcatgatggatattggtttatagtggtttttttcttccctacttccttcctctgtttctttcttcctttatttgtttgttttgtttttttatttttttggtatcagggtaatattcgtttcataaaataaagaagtattctctcttctgttttctgaaagcgattgtgtagaattggtatgaatttttcttttttctttttttgaaacagtctcattctgttgcctaggcaggattgcagtagtacaatcatagctcactgtacccttgaactcctgggctcaatgatcctcctacctcagcctctcgagtagctaagactgcaggtgtgcaccaccacagtggctaatattttattttaaaattttagagatggagtcttactgttttgcccaagttggagaattcttatttaaatattcggtagaaatgtccagtgaaaccatctgggcctggatatttttttcctgggagctttaaattacaggttttatttcttgatagttgtagggctgttcaagttatctatattttatattggatgagttgtggtagtttgctttagttttcagaagtttaattatagtgtgtctgtattagtgcattctcacactgctatgaagaaatacccaacactgggtaatttataaaggaaggagatttaattgactcagttccacattgctagggaggcctcaggaaacttacaatcatggcggaaggcaaaggagaagcagacaccttcttcaaagggtggcaggacagagtgagtgcaagcaggggaaatgccagatgcttataaacccatcagatctcatgatatccactcactatcatgagaacagcgtaggagaaactgcccccatgatccaattacctccacctggtcccgcccttgacatgtggggattatatggattatgaggattacaattcaagatgagattttgggtggggacacagccaaactttatcagagtctattcatagatttccttgggtttgttctatgtggaactcttgcttcttgaatctccttcttgcttgcttcttgaatttccttcttgcttgcttcttgaattcttgcttcttgaatctgtaagtttatttctcctcaccaaatttcagaatttttaagccattattttatcatgtaatttttcagccccaacccctttctcttctcctcatgataacatgattattagaacttttgtatagtcccacaggtccctaagactctgctcatatttttgtcaatgtgttttctctctgttattcagattgaataatttatattgtcctgtctaccaggtcactgtttctttcctctgttttctacagtctgctgttaaacctattcactgactgagtttttgatttgttattgtatttttcagctctaaaatctccatttgtttcttctttatatcttctgtttctttgctgagactttttaaaaattttatatattttttattgacatggtctcactctgtcttccaggctagagtgcagtgatgtgatcagagctcattgcagcctggacctcctgagctcaggtgatcctcccacctcagcctcccgagtaactgggactacaggcacgcatcaccacacctggctaattttttgtatttcttaaaaagacagcgtttcgccgtgttgcccaggctggtcttgaactcctggcctcaactgacccacctgcctcggcttcccaaagtgctggggttatagggttgagctacaatgcccgggatctttgctgagactttatatttctttgctgacgatttctagtttttcatttgtttcaagtgtgtgtgcgtaattgatcatggaagcatttttaagtgctgccttaaaagtatgataattctaacatctttgtcctctcagtatgagcatctattgattgtctttttttatttggtttgagatcttcctgattcttggtatgatgagtgattttttaattaaaacttgggcacttttatattatgttataaaactctgtatcttacttaaagcttctgttttagctgcctttctctgacaccactccagttggggaagggtggggtgctgcattgttatggccaggtaaaggtagaaatccaattttccaattcagcttccagtgacagttgaggtaaaggcttctcatcattgctaagtgaggatggaagtttcatctccccacatggtctccacttggtgggggtagcatcattaccactggatgatggggaaagtcttgactctctactaggccttctctgacaccacctcgttagtaaggtaaacggtgcttcattactgctgggtaggactggaagtccaagctccttgtgtggtcaccactgacaccactggagaagaggggcttattactagttgatgggaatgaatgctgtgcacctacttgccttctctaacaccactctagcagaagtgtttgtatgccttgtgacatcctcacaagggtagaagtctgggctcaacacttggcttttgctggcattgtttggggtggggctacagttttttttatggtattcagctgtagtggaggagttattgtctaaaagcattctgtcttgttagacagcatctttcctatccattggttagagagagtaggcttttgttgaagcattgtttatacctattggcattttcagattgtctgcttcttcagctccaagtctgtgatatatgacacaaaaataagcccagagaacttaccaccatgctgtgacttgttccccaggtccctagctagtctgccttctctttattattcatagtcttcttgcatttatttatgtgtaatgcccaaggttttttagttgtacttaatggaagaaatagggcaaaatacatctaccccatctacctggaagcaggtgtcccactggcctaatttttaacaactaacctgcattaaaaaaaaaagttggggtgccacagaaaacatgatgtgagtagaaagtaataggactgggtttttgttgttattgttgttttataaaattactgatactgacttattcatacaagtgctaattcctcaaaatcagtaagtaagttatcctttggagatgattctgcttccagacattttaagaactcttttggatttaattttagggaatgaattgtgttcttttgaacattctcagtggcgtaaattgtaatcttttaaggcggtgtttgatttttggaagcaagcccaggtggttcaagagccaagatgggtaataaaacagatgaccaaattgagtaacataatatacttcttagtctaacactcttttttaaaagaccagtgtaaaccaaatcatttttacagtgataaagccatgtcttttatattatacaaaacctcccaaatacttccaactgtcacataataagcctgatttgctgtgggatgaattttgcgtgaacagtgccgtttgctatcaaatcaacaattcttttctgtggtttttgacataaatattttcttgagtcttatagatattagagttttccctgtaaactttgacagttttttagggggtcaacttcaaaacaacatactccatcactattctcctcaaatacatgttattttttacaaccaacctccccttgaaagttccaaacaaatgtcaaattttctctatttctttttactattcaaaatgtgtagcacaggctttacagaaaccttcatgttcaaattccccttcagtatgagtcagtgttctcatagctaaccctctgcatgaataagtctagtctcttacattttctacattttcatcagttctttgaacttcatcatgaacatcctcattacttttctcaagcctttgtgtcagtcaaaaacaacttcctctttacagtccttctgaaccattattgtccctctagatgtcttgtcatttatgtttgtttaactttatttaaaaaattgtgtaattctttgctttctacagctgtcattccccaacatcattcatcacagcctatagcccaagagagacaaaaaactgctgctgctgctgctgctgctgctgctgctgctgctgctaacagaatgactttacagcatgttcttttcatgcccattgtttgttttgccaagccatctaagagcatgagcttaattacttcatactaatagattactaaatacaaaagcatcatcctatttgcttaactgtaaaggtcgaagtcacatgcacagcatctaaaacagatgatagacctaattcactaagtagggaattgccttttggcaaattaaagagctgctaaagaaattgaataatatatcccctctcaacaacttgatccttttgttccttttcatggttccttttcaattcatggttcaactaatgagggtgggtgtcaatttgcggggaaagggtggcagtataatatagtctttaaaaggatgacctttgatagacagacttggttcaaatgatggtcctgtcaggttaccagttgtattacttgggaaatgtacttaacctcttccacccttagttttgtcctcagcaaaattggataataaaaattacctctttaacactattgtgaagtttaaagaggtaatatgtatatggtgttttttgaatgtaaacactcatttacactgagtgtttgggtggtagctattatttattaaatgccagttactgtgtcagtcattaaaaactgtaagtggaatatgatgcttgctcttaaagagttcaaaatcagcataatcctgagctcacatcctgtcctatcagaagaaaaaatatacctgaaaagtaagtctgaaggctattacaccgggagttcaaggctgcagtgagctgtgatcacaccactgtactccagcccgggcgacagagtaagactctgtctctaaaaataaaaattaaaactcaattcaaataacaaaggctactatagttctccaatatatagcattagcttttcacccttgaatagactagtactacaatactctaatcaacaaagtaatccataagcagttattaattttctcatgtagattatatttcatggaaccaagctatgttctggatccttctaagtttgtctgggtggaaaaatgctttgcttatctatatgatcactttcaattaaactgccagttgtcacttccgctggttcaagcactggctgaagacccatgaatattctgccagtggaagcagatataaacttaaaaatcaattgatttgtcagtagccaggccagtcaccctcagtcagatagttccatccccggctcctctgactcctgaaatcattttctctagctatgtaactgggcatgccagtgagttcattcagaatacagcggcacaggccaggcactgtggctccagcctgtaatcccagcactttgagaggctgaggccggtagatcacttaaggtcaggagttcaagaccaacctggccaacatggtgaaaccctgtctctactaaagatacaaataattagctgggcatggtgatgcaggcctgtaatcccagctacttgggaggctgaggcaggagaatcacttggacctgggagacggaggatgcagtgcaccaagatcgtgccactgcactccagcctgggcaacagaaaaaagactccattgccaaaaaaaaaaaaaaaatacatccgatcaaaatgtgatactgagcttatcatggatgccctctcctccaaacaaaagaacacaatgcaacttacaccctctggaaaaaaaagaaaagatattccatggcagcaagcaagagttgaatttgcaataaggaaaaactcgaccacaagggtgtttaatcttctagaatggctgaaaaggctgcaatatcttctttcattaagatttctgagaaaggaatagatacaatagagaaatacagatttgccctttatgagattatcttagttgtatttatgaggttatagatctgtaatcactggatatgcgttggacagagttggattgataattgatttcacattgtgctggtataggctgaagcccttttttgcatcttttcctcccgtttctcatgtctgagatatctttactgttttcaaatgtaaacaattgtaaattataccaagacagtcaattggacgtctaaaatataatcaaatggttgtttattttgccttacatattgccaaataataatttttaatattttcttttgaaattgtctcttgtttggaatccagcaatatatttttcctctgaaaatgatttttcattatcactgtagtgttttttatgttgctcttctttaaaaactttaaaataattaaatttaatctcttccatgaatacttatttagtaattatctttttattactccaacctaacgttttcatagtaatcaaaaatcttgattagtcaggacatttcacaagctttcctagctaatgaattcaaaggtgaaattcacttttgaattcaagtcacctatccttaaaagatcaagaggaaagaaaatgaattcaggaaataaatccccacgtctttcaatagcaatgggtgaagtactaagcacagcactaaaatatatgtttaaaattattcatgatcagcattcattttctatgttagacctccatgttaaaccattctcagtttagaaaggcatattctggcttaccagctcacacacaaaactgcttgcttggtttgtagaaaagacatgagatagaatgacgcaaggagctggtgctaaaatgaaggtgagaaaacaggagtcaacaaagaagtacgggtatgatcgtatcatttaaagatgagagaccgcagcaagcataccctctctcctccacctttaagaattcagaaatgatcattatcggtttaaataaagggtactgattaatctctctgaaagctcatgactagatgatcttctgcagagagagctcatttcgaagacggttccatagctagtgcccccacaggaatttatcacatgattaatttttaatgtaacttagagatttcaaaggctgtatttgaataatggtgataattgataaatattggttttactcatctgaacaaacttacttgcttcagaatcagaaaactgtttccatcattttccccatggtgttacatatattaacatctctctgtaactctctggtatatttcaagatgaaataccagatacagctcccctttatttttaagttgcgacttaattttcttcctgagatttttcaaactgaattttcttcctttaaagtgaggttaaaattatctctggcaagccagcagatgactatgaatgtatttaatgtgaccttgctccaatattaacattttcacaaaccacagtaggcagacccttactgtttcttcattatcctttctggccatggctgagagcccaaatggtgccgctttaccagagaggtattctgtacgtgctttctactttaatcacatcctttcagcaccatgaatctttgcctgacagattatcttctccacaggcaggcagccacatccagacgttgatggggtcccaaagccttcagcatcgcagccgggagcagcagccgtatgaaggaaatataaacaaagtgaccatccagcaatttcagtcaccattgcctattcagatcccctcttcacaggccacccggggacctcagcctggacggtgcttaattcaaactaaagggcaaaggagtatggatggatatccagagcaggtgagaagtgtttctttattactgaaaaatcttcaggtaagaaaagtccaaagaatccatggttggccttccctcattaatgtggtccaggacacaatgccatcaccatgttgaatggggtagggccctctttgtggggattttatcattctttccagtggttaaggactacaacatataggaatttatggttggtaaaatacccattttacaaaaggaaaaattgatggggcagaatagtttttccagtaccatcctacaccctttcctacccactcctaactccaatttagctctacagtacagattttgaatgttataaaggacttcaatggattaggtatatttaccaagtctgctgttgaaaccttcagtgtgaaagtaaactatattatttcccccatctgtgggaatatcttttaaaagtcctatcttctgattgttgaatggtgcagagataaagctttgctatgaagataattataaagaacagttagaagggaaatgtttctgacatgcttcaaaagttactgataactgccatgtagcaaaaagaattgcgctcttcaaacctatctaaaattaggatttgcttttccattgtagtatctgttttagttccttaggactggaaaactgagtgggattgcatctattgaactatattaatcttagaaagtaaaacattaagatcttaatacacttaaaattaatttctcttatttcattattcagatagataggcaacattcctactgacttttctaacttttaatatggtctataaaagcttcattttattattacttatcaaagtttttcatatcaccccacctgactttctaaacatatcaaaattaacttcattctccagattttccctttatattgttaagagccatttatcatttggattccaagggctttaaacatctcctctattttgtaatatccttcttgaagcctagattacgtactaatcattctcagaatcataggtgcattgtaaagataatcttctccctctcctgccttagtctaggtcaagtgttgaatttaaggtatcataaaccagacaggtgcctttaatcagataatgatatggggtttttaattctccagatactcttaaaagttaatacaattttaaattatgctttaccaaaggcatcttaggaggttaaaaaattattcatagatatgacttgcccacaagtatcataactcaaaccagttctctgatttagttattcttattaacagctacatggttttttcctcccagaatcaatgcatttgaaaacgcactgagattaatgctatcggttttcgcctacattgaaaagtaggtttagtgttagcatgcaattattctgaacacccaaaatttaaaggctattttaatactatttccccaaaaatgtaaattatataaagtttggctagtaagaggattactaagttttaaagtttacacatgtattgagtttagaacattatgattatttcagaaaaaatgtatttatagtagctctcaaatgttttcattcacagcttgataacatcaagtacatttcaaactgagagataaaatttaagcattcagttgaatgcttaaacctgtctgaactataactcagaattgtagaactgcctatatgttaaggaagggacttaaatataacaccttttgatgtctcagttttttctgccttggtttcaggctgaaatggttttagatgtattgtacatttcaaaatagctagaagtgaggacttggaatgttctcaacatagagaaatgataaatactcgtggtgataggtatcctaaatgccttgacttgattacacgttctgtgcatgtgacaaaatatcacatgcaccccatgaatatatacaaatatcattatgtatcaataaaaaagacttttgagtgaaagaaagcctaaaggcatttaaacaaccagttctggtccccaaactatgttacctgtcatcccgttataaaccttgagtcagtttcttaaagctgttttcacagttggccagctcatattggcacattgtcatgtgctcctcttcccaatggcaccttcaatgacatcatattaataggttgaagttgtgggaaaaattataccaggaacatcagcaaacactccaaattagggcactctccaaaccccaaccagctgtttattaaatattttccagcacaccactgactactaccctgatttctttcatctctttttctttttctaacctctccacttcttcatttagcttagtgttcaagaaagagatactaggactaggtctcagaatttggagttctagtttcatgtttatgtttattagccacttgtccttggccaagttgttaactcttcctgagcgtctgtttctctcctgatcaaatgagaacattgctacccaccaacaacattcaaaaagaatttgtcagagtcaaataatacagttctacatatacgcgcgcgcgcgcgcgcgcacacacacacacgcacacacacacacacacacacacacacactccccgtaagcttagcactgagggtatagaaacagaaaacagtagaaatagaatattttaagaattcaaatatttgaagaaacttaatgattatcagtcccagcctccttcatctacaaatagaaaaacaaaccaagaaacattaaaagaggctgaaaggttatatatttcactctcataatgaaactatttcatgtgtgttttactttcctaagttatatttcttttgaaaattgagacctttttaataagtgtatgtggctgtgtgttttaaaagaagacttttattccaaatttaaccaggaaaaaaatggagaacatttaaaacatgtaaagactttatggagattcacatgaaaattatggagtagtgatttaagtgcaaagagcagtgaggtaacataaaatttctaatgtagatttggggcatataaatcaaaacagtctattttaataagacatttctagtggtgctataaaagagccataaagagaaaagcaaagttcaacttaaattatctaacaacaatggtaaatttggtcaggtacaatatggaaaaaaattattcaacatttttaagagcaaggagacacagtaaacgtggtacaaagaaagtctactcagtataatacaacacaataatttctgttaaagtaaagcttggaaactttagttaaacagtagtcacttattgaaatactacaggtaaaacaaaatctgattacagtgaatacatattttttcattcaggaaaaggaaatctgaatgaaaatagcaaagaaagggacagcagttaccatatattaagcacgtgctatgtgttttacactctatttctcacacacaggtctggcatcagaggcatgtgacctgtagagttgcataaggtcctgcacttaaaagggccccacatttggattaatgccctgctgtcaccatcttgtaattcttaatagttgttgatcaaggagcccactttttcattttgcatcaggcccaactaattatataaccggtcctgcttacatatactattttatttcatcctcataataatcttattttctttttacaagtgaagaaaccaaggcagagagaaaataatttatggaaagtgtaattggccaagctggaattttaagtcaggtttttttctgaccccagtccaagtcctgtgtcctaatctcactgtaaaattcaccacatgatctcaatgccctctctgtcaaatgatattaattaaacctgcctgaactataactcagaattatagaactgccttatggagtgttcaagtgaactcacatgaatacttgcaattgctttgaaaagaaaaagctactgaacaaatggaaacttttattattaatgaaaacatacctctgtatcccttaatgtcacccaaagaactagtgtatttttaacctgattaaaataagttccatgtggaaatgaacatatataataagtgccaaaactgacgacattgaatgaattagaatgagtgtcatttgttatgtaagcggagtattgaactttgtttaaccatgaagaagcatttagtaagctttgaggctcctcttcagtgataaaaccatctaaactttcaaactacccatcacaataaaaaggacaaaatattcaagaactctagaaacctaaacttctggtttaatgcacttattttcacgtttatttttcagaaataatgagtatcaagtctgttttcaactctaggtttaaattaaatatatggaagttatgtttcaactataaaatgttacccagattcagtgtattaatttctgtagactataaatctgacttcaaataatatctgcagcaaaaaccatgtgcatgtcacctgaagttcattatcaggggattttacttgaaaaggagattttagtgcataaaccgtttagattacttacaaacataatagagggtaaaagtcagagttgtattaagtagtgaactgaataaaacagccagaaagtgaaggtttgactcccattccacatggaaaacccttcatcagaatattcatcctattagatctctcctttgtgtcccagtgtaactgaagaagcttaaagatcccatccaccttatcctccccttcacaatatggtaatgctttatataaattgttcttaaccgcagctgcagaatctgttgaggggctttaaaaaacactgatgtcttgctctcatccccagataaactgattttaataggctgcatgtgacctgggcaatgagacttttgaaaactccccaaggtgattctattgtgtagccaaggttgaggagcactgctttagatgttctatagctcaacaatttatcagctgaataatatattgagaatatcactatttaaaagcatacataagttgcccataagctgttggatatttttaaaagaaactaacatcagctttgtttctcccttttgcaaatgtataatacaagacacagtatatttaaataagtagatagtatagatgccaaagcagaaataagaaggaaaaacatcagcatgatgcttcaaacctttcaaaacccttttatgtattcactgatttaatttaattgataatgttgtgatataggtagagcagtttccattttatagactacaaaactaagactaagataagttcaatgtcttgcctgtggtcacacaatgtagaagctgggctgggattagaacccagtctcatgagtctaccacattacatgctgcagcctgcgtcacatgtcaagagtaaattgacactggaagagtgaaacgatggaaaagtcaagagtagccaagcacacaagtcaagagtaaattcatattggaagagtgaaacgatggaaaaatgcacccttcactccatgtctgccctggacaaggggacctccctaacatatcaaaatggcaggagcccaaccaacctaacacatcagaatagcaggagctccatggctgtctcctgccagtgcctgcaagtatacatgcaaattaaagtttgtgcctgaaagagaacttctaagctcacattagaatcagcctcagagagttataaaaaatgatatgcatccatcatatttaagggaaaaaaagttccaaaacatactcacaaggagatgctgtagtctatcctggaagaaatcactttaatacttaatattatgtggaatacataaaacagttagctgagagacaggatttcagacttctctttagattagatgctctggtcaactgcccaaagagcactcaagagttccaggtgaggacttcatttattgtgtgcaggtgaagaaaactacattctgctgagtggtgtaagaagaaacatttggagatatttgttttatttaaattataaattttttaattaaaagggaatagttcagtaaaggtatttgtaaaataggtattaatgtagttttaatctctgttatttactcaagttatttcagggacatcctgtgccttatcctgtcccacttaaagaattgctatttgtgaatatttcccccatagaattttattctccagtcatcaaaataatgcttcagttctgaatttgtaattcatagtttgacacagagaatgtgtgactcaacatcagaaattctatcaattgactttataagttgtgtgcagtcatatggtagaatgcagtaaacattgcagtgggaataaaaagatttatttcaatgttgcactaaatacatattatcttgttggtttccttaagtccaaaatgaaggaaatgaaatgactaatctttaaaatttatttccagactaaaaatgcatttgagtttctgtttcctagatacatacagaatcagctaattttttctgaaagacctagaaagtgctacatcaggggattttattagtcaatcttgataccagtacatttttttttttttttttttttttttttttttgagacaaagcctctgtcacccaggctggtgtgcagtggagcaatctcaccacagtctccgcctcctggattcaagcaattctcctgcctcagcctcccgagtagctgggattacagcatgctccaccacacccagctaattttggtatttttagtagagatggagtttcgccatgttggccaggctggtctcgaactcctgggctcaagtgatccacccacctcagcctctcaaagctctgggattacaggcgtgagccattgcacccagctgaccagtacatcttttggaaagatttaactaggaattttagctggatttgaatctttcattcacaagaggaaaagatttgaatatagaagaatttgtatttcaaaaaatattaattatccttgaatattaacatgtatacatttttataatcactgtttcctttttgagcctatttcatgggcttatcagaaattttggaaaatgcagagaaattttatgtgtattttgtatggctaagtaatgtacataatgtaagtcaaaatgaaaaattataatagcttattattgcatagcactctttatcataaaactgctgttatataataacccataaaaccaggagctaaaagtagcagtaactttaatttcaagcttaatttacataccatgaagcattctttctgcttttgtcaagtcctatcgtcaaatctccatcctcatctcatctgacctctcagccatgtagtttgacctttttctccaaaatttgtatccccagccttcgtctctctccttcactccagaagtttatatgcaattagctacttgttgacatctcatcctggatgtctgatgagtttcttaaacttagcatggttttagaaaaccacttcctgctgctaactctaccaaacctacttccccatttcagttaatggcctatcacccttttgatatgaccaaacgtccttgattccccttcctcacagtctacactcaatccacagcaatttcatcaaggtatgtcttgaacccaccacttctcaccacccacacagctaccatcttagttggccgtaacctcacacctgactacttcaaaagcttccatattgctttctcttcttccagtttacctccttttgtctattctccactactaaagtgatcttttttaataaacataaattatattacaccattcttcctcttaaaatgctctagtggctttcaacatttctgaataaattttaaatccttactatggtatagtgtccctgcagatctagccccaccttcctctccttctattctttctttagctctgtcatgatgaccttgttttttaatggctttattgatataatttatatacagtaaagttcatctgcttaaagtgtataatttattgttttcattacatttgtacagttgtgtaactatcactataatctaactttatgacattttcatcgttcaaaaaaaaactttgcatccttgagcagtcactttccatactccctccagccctagacaaccactcatctactttctgtctctatatatttgcctattctggacaattaatatgaatgggatcatacaatacatgtatttttgtgatttgctcctttcacttagcataaggaactgaatgtagcatgtatcagtatttcattctttgtcattgctaaatgatattccattgtatggatataccacattttgcttatgcatttatcagttgatggttgatggacatttgggtttctactttttggctattaagaatagcactgctgtgaacattaatgtacaaatttgtgtggagatatatgttttcatttttcttgggtagatacatagagatgaaattgctgagtcatatggtaattatgtttagcattctgaggaactgccaaattcttttctaaaagtggttacaacatattaattccgaacagcaatgaatgtgggttccactttttccacatccttaccagtacttattattgtttgtcttttgtactgtagtcatcctgttcattagtatctcattgtcattttgatttacatttctctaatgactaatgatattgagtatattttcatatgctttttgaatgtttatgtatcttctttggagaaacatctttaaaaatattttgcctatttttaaatttggatgtctttttattattggattgtaaaagttatctatatattctggatatacaaccctaatcagatatattatttgcaaatattttctctcattctgtgggttttcttttcactttttgatggtcttctttgaagcacaaaagtttttagtttttatgaagtccaacatatcaatctcttatatcatctttggtttcatatttaagaatcattgcctaatctaaggtgatgaactttactccttttgtattttcatcaaagggttttataatctagctcttatgtttcagcctctggtctactttacataacttttgtgtatggtgtgagatatgagtacagatttattcttctgcatgtgggtatcttgtcccagcaccatttactgaaagactcttctttctcccagtgaattaccttgaaccctttgtcaaaatcatctgactataaatgttaggatttatttttggagtctctattctattaaactgatctatgttgtttcttgacgtatgccctaaatccatctttagggcatttataattgctgtcccctttgcttgggatagtgtttcatttttcttattgttcattgtttgatctttggcatcattcacatttctgctcaaatgtgacatactcagagagggtttttttacctactccatcaaaaatagctctttcctgaggcaagaataagcttaaagtaaataaataagtagaataactcctcattccatttcaattactctctactacctttcctgctgttttccacagttcatcccactatctgaaattacttatttgttgtttatgtttgctatctatcttcctcattagaatgtaagttctttgaggtcaaggatatttttatctgcctggtacttagtagggaatcaataaatatttgtggaataaagtcataaatcattattttggcaacagtttttattttcaaagctacaacatttttccagagtagtttatttcaaagtcattgataattgaggtactctttgaataactgacattccttctaaaactcatcatgtattttaacaaggagtcatcgtatactttttattaaggaaggcagggagaattttagcctttattcttatttatttatttatttatttacttatttatttattttagtgagagggctcacccaggctggaatgcagtggcacagtcatagctcactgcagcatcaaactcctggtctcaagtgatcctcctgcctcagcctcctgagtgtctaggactacaggtgtgcactaccatgccaagctaatttttgtaacaatccattttattaaaaaagcctttccaaaataagacccagtattgtaattagagtaagattaacacagaccagaagttatcaagtaaagtagaattatggaagcagactctgaaagaccattgattgcactactactgcatatgttttcggccaaaccattcattctttaaaaccggtctcttaaaagaaaactgagtctggcgtggtggctcacgactataatccaagcactttggaaggctgagatgggagaattacttgagcccaggagttcaagacctcatctctacaaagaaaattttaaaattagccaagcatggtgacatgtgcctgtagtcccagctactccaaagactgagatgggaggcagaggctgcagtgagccaaaattacgccactgcactccagcctgagaaacagcaacaccttatctcaaaaaaataaaaaataaattaaaagaaaattaaaataatggttctcattaaataagctatttattagcttcctagacctaatcttttactagaacactgcatttcctctttgctgatcctctttagtttcagactgcttcctggatgtaaggtattctgtcctcttacattttatggcttctttgggccttagcaggcaggtggaactacttatatgtgagaggaatactctctctgacatgctttatgagacccagtagtcacaatacaacctattagccataccttggcatgcccaagagcagtctagcctcagatcagaatttatgtttgtttgtcacatttataaaactacagtgtcatcattatttctcttattaaaaaatattaaggcagttcttcatacacttggcacatgtgaaatttgtttctcttagatttttagtgccttccagatttacaataatataaaatagatatagtcgctaccttgaaagagaacaactggaaactactctcagcaatttactttgtaaattaaacctgttacatttgtttcctttgagttttatagtggcctggagaaagccagaactgcatataccttctgcatattatgttgtggcaatatgaaatgttcacattagaaagatataaccccaattttaaataatataattggaaatgcatagaaacattgaaaaacacaaaagaaaaatgttttcatcatattggttgctttcttctcattttctaattaataaataataacaaagagatcaactagcacactgaataaggctaaaatatttctttcagctacatcaggctattataagtttatattcataaactaggatcaatataaaaatacaaagtattataaactgtaaattctaccacctatgataactagttttaacaaatctagctcaattgaaggaaaagttataattaaacatctttaaaataaaataagggacagtacttatagtacatttactcataattaagaaactattcattaatgactacataaaaatcacattagtgcatagtttttcatctttgtgttgccagtaaactatctaatatttaaacattatatttactattgtgaaatatgacagtgaattaagtataggattattaaacagacaaacctaattgatccaggttctagtgacaatatgtgctaattaagtcagaaataggactcagtttgccttgaactaagaggtagggattgaagatagctcacaataaaaatgtaaagagtgttttgggcatttacatttgccataagcaaattaatgggctaagcaagaattctgggggtaaaaatgggctacttaagaaagcaaatgtttacaatcacttttaagaattcttccagtatgtagctatgtaaatacaaaatatatgccaaagtgtgtcatcttatgttttttcttaactctttattaatcttttgcctgctaacctttggtaacacttggttcacctaatacttactctgtacttaaaagttgtaaaagagttgggcacagtggctaacacctgtgattccagtgctttgggaggccaaggtgggagaatcacttgaggacaggagttcgagactagcccgggcaacacagcaagactctatctctagaaaaagaaacaaactgaaattattcaggcatggtggcatacacctgtaagtctcagcttgttgggaggctgaggcaggaggatactttgagcccaggagttcaagtgaactgattgcaacactgcactatagcctgggtgacagagtaagaccttgtcactaaaataaataaataagtaaataataaaaaataaagttacaaagtgttttttctttatgtaaccaatgtatactgcctcttggtccgaaatctttcaattatttgggatcaccctgtcccactttacctggagaactaacatttttaccatagcccacatacacatctcctgctcagggtctccaggaattcttaggtttgttagagtttctctaggtcatccctggcactgatgtcatttctgctgagttcttgatctacagtctttttattaacttctattattgctataatttttactacagccttatcccaaggcggaccctacccctaatgccatcattcccccatactactataaaacaaaagtcatgtttaatagactttcattcatgatttgggatgttggggaggtaatataacagaacattagaatgtttgcccttgtgttgcgtattggccattctctttccctagcaatgtctccatattgttgacctctttctttaactagacctcatcacactattctcccctttcttctaaggttcctaactcctactccaggagctgctgctagacttgaaactcttcactgagcatttcatttttccttttttttaccctcacacaagctgtggctactttctcaaactaaaagatctaatattcctaaacaaagaattatctaacaaggagatgaattaatctactctactacaaagcaggcacaatttatttaaatagccatattttctttcactctacattttaaagttttgtttcacttattcagacactcctttctaatcaacctgaatacatgtgcatttatggttgatagctaagataatgcatagtattttaagtgtttataagacttttaacttttaaaaatggctaatcaaaatttagtcctgtacatggtaacaaataagtacttgctaatatcttcttgcccaggtaatttcaagcgagtttccatcataactgatgcatatagaaacattaaacattttgtcaaagtttatattgtcttttgtgtatcaactcaacataggctaaccctaagaaaccaagtgaaatgtgaatcttttctactgaaatacagttatttgaaaatatttagctttgataactgtttacttaccattttatatcttttttacatagttttgtgtgagaatagaaaagaatcctggccttggatttagtatcagtggtggaattagtggacaaggaaatccattcaaaccttctgacaaggtaagaaatgaatatcttgttgacaatattaattagaaaaatactatctcctacagtaacaaaggttagaaaaaaattcaagtgtttttgttgtgttttcatgagctagttagtaactctgaagccaattagaaactttttcagcacagggataaaagaatttactgcagcgcttgacacatactaagaataaagggaaaagtctctaaacattctatttaaaaggcagagattttttatatttttgtggggaggctttgtgttttgtttttgtttttgctccacagttgtctatatttgtaaagaaaggtatatagacaatttctaacaagttgtttccaaaggttaactcgtaagtcacttatttaggaaactgttttctcacagtagcagaatgatgacatagtaattcaatgcaaaggcaagctgactgccatctcttcaattcatcaagcatgtaaagaattttgctaatagaactgtagaattgagaaaccacagaaaacaaattttttatgagaaaatcagttagcattagcagaagaattaggtcctcctctcatacttacccctgcttgtcaaactatggaattaaggcacaccaactctaacctcagccatttcctggacattcaagatgttgcctctgctcacatgtgacctgcctgacgccgatgtgaaccacctgattttttattttttaaatgtttacctggagctatagaacctgccctgctaccatcagtgtttaatactctcagctttgaatcaattaataattattcaatgataattgaagctatctactttcaacctcatcaaattgcattaactgaccccataaaactttaggatgatgaagaaggaaaaaaattaaatatgaataaaacctccacaggctctgtacttacctttgagtcacaacctggtccatatcctctcaactcatcacaattataaaaacctacagattaatttctgattatgagacctacttctgaaaaacctgggatgccattactctggagctttctgtagcccgaaacagagcctttaacaccacattttcctcatcttcctcccagtgatcttgtttcttatactcttcctacccttcttcctttccgttttggggaaggtcaggagaagaggttggtccaaaaggaagaattggtcgcatgattatatacattaggaatgaagagaccagaggaaaatctccagtgaccaaggatgggagctcctttggtcaacaggctggagcagctactcatataaaaggaatgtatatgaggcaatcctataattaggggaatgccagttggaaacatctgttcataggtaactagcatatttccattttgaaatgatgttgaggataccattgatttattacaattaaaatattcatggcttagaccaactgtttacttaattttaataaattattgatacatcttaaagaagcataaaggttcaaaattatcagaagcatgatgacattttttaaaacctcaaatcattatgtcttatttatcttgactcctctttttgtctttcattttacatctctttcataaattctttcaatgaaaagtcactaaccttatgatacttaagagagttgaaattcaagacatatttttctgttctttctcaccagcatataaatcttttcactatatttttggaaggtacagggtaaaaaaatatttttaaattaaggatgaatagattgttaagtagtcaagatgtcagaatactgttgcatttctgctcttttcaactgaaagagactagatctcaggctttcaaatcattgcctgcaattcttccactgtgatgaatatgaacactttatagctattcatttaatttctcatttgtaacattttgatgactctagtgagactgaactatgtctatgatcttataatttgctcttttggttaaatgtaacagataaagcacttgaattgtataatgcgtccattgaaagatttcccctaaaaagcacttttctttggctgattacactctaaaatcattcataatctgaaaagtaaatctctattattataaaattggtgggagcaactaggagttccaaatctacagaagaatctcaatactgcctttcacttattgaccagttttggtggcatgccaaacatatggggacactttggttaactgttcagaggatctaaagacactgactgacaatttacataagaattcagtccactcacaaggaaagggattaatctattggaaattcagctgtgttttttagccctagtgccctattctgaaagtgttgcataaaatttagagtagaacccagtgcctgaaactacctaaaaatattaaacagtaagaaaatgaaaatgttgaaaaacagattggtttttcatgaaatggctgatttacagctggaagtaagaggaaccaagttaaacagatgtttaagatcaaaaaatactgcctgagcctgaggtagacttataaggagtctagtcatgcaaaagtttaaactttaatatgatacatactctcttcaaataaataagtcattgattaggaatattctcagaaatacactatattattttccttactgctcatggatgtttgaatgttttgctgctcaaaattctaagtatccaagaacatctgaatgtcttagaggtactgaggactttctgtactgaagttaattaatacatttgttccattctcttcattattgttgatggaaactagtttcagggaaatgacaaggaccaatgtgagatagcatccaaaacgattacagccagacagggaaagactgaaacagtcatctcaaaaagctgagagccacagctgcagcaaaagtgaactatattgttcggtctggcagacattctgatctacgttctggggtaatgtgagattgttgcagaaaaacacttagggcagcccaaaagttaactgaggctttatggaggaatcaggattaagccaaatataagggaatatttttaccagactttgagcatttagaacagcatctcatctagcaaacttaactccccttcaagatccaaggtagtcttgatcaaatattggctcctccagttaaagggatagagcacaattagccctgcagttgatattgtcaaaacaatgtttagtagtgaaaaacaccagttcattcaccatagaactcattatttcagtgttcactgtcaagcagaaactgcttttacatacttggaaagagaaagcagtagaacactggatggaaattagttgcctctgtcctctcaatgaagtgtataatagccatgatctgtttcattacaataaagaaacattgctgtcaaattgtcaagatactgcagagagatgaaagattttgagccaacaaatctgatagtaaagcaataaaaataatggccttttattgagtatatacaaaatgctgggcactgtattaggctctttataaatatgaatttatgaatttatgtgatcttcataactatttctgttagttgagtagtattattattccccattttattgaggcccagaggggttaattaacttgcccaaggtcatttagctgatctgtggcagataagatttgaaacaaaactgagctgactccagatgcttttcttaataagcattataatacatgcctctatctgcaaatgtcacttagcagaagagccacatgacaaatttataccctgtagagttgagactaatatgatattctaatattgagagtattacagagccctctaattagtcatagtctagatatttttttcaacaagtccttgggagtcagcatgtattctctgttgaacctagataattaggagcatactgtacagagaagattgctaagcaattatataacttgtggactaaggtatcattacagtggtgattctgccaatggagcaagccacaatattctttgcttgtatgtaagcactcataaaataataatttccaattgcaaaatttaaggaatttaccagtataatttccacaggatgttgttagaaagaggaaactgcattaatagataactgatgccatgctgttgtaacattttataaggcaacccaggactctgcaaatgagagaatttttaatgatgcattcacaaaactcatcattcagggattcatgttcttccttgctccatctgagggaagaagaactaagctcctggatcttaaagagattaaagaagacttatagccctttccctatatggtgtaaaggtgttacactgaacagttgcatgaagaattatctactcatagtatcaaaatgaaagctgttttatggattcagcccatcctcaaaggacctgacagcagcaaatatacatactggggcattggggccagagaatcagttatcctccactgtccaccatttatgtggagaatagtcataagtgcctaagctcaacagatgccagagagctcatccatatttccactaagttgggccatctaaatgtagccatagaaatgatagaaaaaaacaaattcatggtttttttaaaatgccttaatttgcctatggtacaggtaaaattccaagccatcgaaagaatattaggagcatagaaaatgtaaactattatcaccaataaactctaaataaatgtcctagaatttcagaataaattactataaattatttacattacatttaaattattgcctccagatgcccaaacagcctgcaacaggacttaagcccctcctcttttcactccattgtttttgtgtggatatggatattacatcaaataaaagtttttacatgattaatattaagaaaagaaggacccttagacatgcagaattgaagcttttatttaatacttttatccaaggataacaatactcagaggcatgcggggcaacggcaagttcaaaaatgcacaagaataatgttccagttttgctcaacttcatgacattgggtgatccataaacaaaagcttgctaaagatatgcttttaacttataaaaaaggtacataccatatgcctatttcctgtcaggttttctccatggatataaaaaatgagaatagcaaacatatttgtttaaaactccatatagcataagatgtatatttactatatgaatattaaactacttttagcacatttccttaactttgtgcagctactagacaaatacaatttattgtatatgtttctaaattcattttgtaagtaatataatttatatatgtgtcacatccttaattccacttcaagtgattatgtaaggcaaagtaatttgaaaaaatttatgcattatgtgaaaataaaattcaggagcaagggatagagatcaaattgtttttgtacttcagactaaatttaggaagacgctgaaacagtttttattttatatataaaatgatttttaaaaataaatttcaagcataagttcttttataaacataactgattacttcagctgcatcttagtcatattgcagtttgaggttcagaatgccactaggttgtttgaagacattaaaagtgagatgagttctttctttaataaaaaataaattttcacctttcagttcattgtcttaatgttggagtaaaaagtccaagatctattcagaaacattggtagagatgaaatgtactcttcacactctcctacaaatagtattcctacaggtgtgacgatttataccaagctttttttaaaaggtatggtagcatgctttagccaattgaaaaatgtcggtatctagacattataatagaaaggagacatgaatttcagcttatgaaagcaaataagtatcattaattcttcaggaaactttcactggggcataaatgtgaaaaagtaaggtcactaaaaagtatcagtgtaaagctaatgaacaattaaataaatgcatatatgtgtactttggaacctaaacattttttaatcaaaatatgaaagcacttaaaattagcttatcaataagatcttacataattactaaaaagaataaccaataaatccagagttaaagagtaagtaatagtagtttaggattactgaataaggtaccaaagtacacatatatgcatgttgttttttttgtttttttttgttttttgttttttgagatggagtctggctcttgtcgcccaggctggagtgcagtgatgtgatctcggctcactgcaacctctgcctcccgggttcaagcgattctcctgcctccgcctcccgagtagctgggactacaggcacccgccaccacgcccagctaatttttgtattttagtagagatggggtttcaccatgttgggcaggctggtctcgaactcctgacctcaggtgatccgcctgccgcggcctcccaaagtgctgggattacaggcgtgagccaccgtgcttgcctatgcatttatttaattattcattagctttacaatataaatagtatagttttacatagtctaagtatctgattctaagtacagtggaaaagagaactgcttcctatatttaaaaatcgtgttgaataaacccatcgccatgcacaaaccacatttccattaaaagggactatcatttaaaccctgaggacattcattaatagaaaacaagcaacctctctagtgtggaattaaacattaaaatgattaaagaaaagtcatatttatttatttgtctttttttgttcattgaggtatactgagttctctgttgaaagagaaaaaaaaaaatcacacgttccctttgtcctctctgtcaacgaatgtttctaccttgactcagaacgactaacttaatggagtacctagacttggcaacctttgcttattcctagactgaaaaaaaaagacccatgatatgttcgagttttgtatgacttgcaccttctggagtagcttcagctggggtggtggcattagctgaggtggcttcagttccctgaaggtgttcatttctgggccataaaatgagaatggccaaagagacgaagagagaatcgagaatgacttttacttctaaatctttgctgattctgctgaatgtgaactgctaccccttcattcatcagccacaggcagtctcaatgcttttactctgtgtggcataattatcctcctttaaatacactgtcagtctcagatgtgtacaactacagtgtcctttttctttaacctatgcctttttaaaaacacataggtaatgaatgaaaatatcagcactgtaaatttttaaataattatagaaatattgagactaaatatgattcccccacccctttcattctgctctacaccacctatgcacagccttggcctaagagccactttattagtcaacatatcaagaattcacaactgtagtgtcttctggcacttgcccccagcctttctgacttcctgagccacctctaagaaatgttctagcatattctgaccatataatgatgcgttagccattgaataaaaccatattaaacctatgagaatcagtctgactgaatatagcttacaacaaacaatttttcacttcaaaaaccttattttagcagaattggttaaagaaagtttcactgaatttttcttttttttaccatttttttattgtactttaagttttagggtacatgtgcacattgttctggttagttacatacgtatacatgtgccatgctggtgcgctgcacccactaactcgtcatctagcattaggtatatctcccaatgctatccctcccccctccccccaccccacaacagtccccagagtgtgatgttccccttcctgtgtccatgtgatctcattgttcaattcccacctatgagtgagaatatgcggtgtttggttttttgttcttgtgctattttactaagaattatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgctgcaataaacatacgtgtgcatgtgtctttatagcagcatgatttatagtcctttgggtatatacccagtaatgggatggctgggtcaaatggtatttctagttctagatccctgaggaatcgccacactgacctccacaatggttgaactagtttacagtcccaccaacagtgtaaaagtgttcctatttctccacatcctctccagcacctgttgtttcctgacttttgaatgattgccattctacctggtgtgagatggtatctcatggtggttttgatttgcatttctctgatggccagtgatgatgagcattttttcatgtgttttttggctgcataaatgtcttctttgaaaccaacgagaacaaagacacaacataccaaaatctctgggacgcattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaattaactaaaatcagagcagaactaaaggaaatagagacacaaaaaacccttcaaaaaattaatgaatccaggagctggttttttgcaaggatcaacaaaattgatagaccgctagcaagactaataaagaaaaaaagagagaagaatcaaatagatgcaataaaaaatgataaaggggatatcaccactgatcccacagaaatacaaattaccatcagagaatactacaaacacctctacgcaaataaactagaaaatctagaagaaatggataaattccttgacacatacactctcccaagactaaaccaggaagaagttgaatctctgaatagaccaataacaggatctgaaattgtggcaataatcaatagcttaccaaccaaaaagagtccaggaccagatggattcacagccaaattctaccagaggtacacggaggaactggtaccattccttctgaaactattccaatcaatagaaaaagaggggatcctccctaactcattttatgaggccagcatcattctgataccaaagccaggcagagacacaaccacaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatatgcaaatcaataaatgtaatccagcatataaacagaaccaaagacaaaaaccacatgattatctcaatagatgcagaaaaggcctttgacaaaattcaacaacccttcatgctaaaaactctcaataaattaggtattgatgggacgtatctcaaaataataagagctatctgtgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaaggctattcaattaggaaaagaggaagtcaaattgtccctgtttgcagatgacatgattgtatatcttgaatttttcacttttcaatttgtgattttaaaatagtgcagatagtgtcaaaaaattatacaaccagaggggctttgagggagccttcaggaattataatcagaaacctgattatcaatactattttaagaatagctgaaaagaagaatccacagcctcctacagttcccactcctgtttttaatcatttttactattttatgttatttgtgaagctgagagaaaaagccattagggactctgactggatcagtaaactgtacaaagcttagcaattcaaatattcaccacaagttggggtcccatattaaatacaggctttaaaggatttataaaataaaataaatggtaaatatttcttttattttttcctaagagtccagaaatccagaaggattgtaagtgaatgaatatgattattgacttttaaaagaacatatgacaagcaagtaaaagaaaattcaagaatttcactaagaaataaacaggatgcaatgcactgtcagtcacaatagacagacatcccagacatgtttaattgttaaacaatagtagaaatactaagcaattaataaaagttaaaacatataaagtaaccaaaaccaaacacaattttagcacttacgttcaaattatctaaaaaagaacagcccacaattatcagtatcaaactataaaaaatattctagtatttatatatcatttctaaaagcaatctcagagaaacaggaataaattgcttatttttggttgcttttaacagctctgaagagcatcatcttgatatatatgctactaaacaaacttttagactgaccaaaaagaatgatgcaagtccaaagaccaaacaatgtgtatttattttgctagaatattacatttcattatattgccactaagagatttgtgatcccatagtccatttctttgggttgcactagtctctttgttgctccaatgcattattaataaatttttttacaaatgcaaccaagtgatttccgttgtaatatttacttttttaaaaattaatgaaactgaaattcctttctatgtgtaaaatttttgttaaacttttagaagactttagtcagttgcagaattttttcttgtatctcttccttaaattttctgtttctaaagcaattctccttctgttcatcttttacagattttacaattaactggtttgtgatgtccttttctttctttctccctctttctctcttcttccctcacttctcctctctcttaacttctaattgccataggataaatcacttctcttgatgcatataaatttatcagttgctaaggtagcaaattattcaaagcgtaaaacttgatgcatagcaattaaccttaaaatactttgtcatcacacttttgattcctggagaggagcactattgataatacctttatccttgatatgtcaagtgttctaataatcatagagactaagtaaatataggcttttatgtatatctaatgttgcttctacaagccacaatatagcttcaatattgatattgcccacattatgaaagaagattaatatttgctacttttttagaaaaaaagtttccccctaaaaattgaatctatggctctgtttgctgttttcatgagtcagttttgcctctagaaacactctttgaacttccatagttatatgaaagcataaaatgctatatgctatttttaactcatgtgttctgaattgtaattgtatataatttttacttgagatatagtctttctagaaaccaatttctcagcatcagctagagccaagacttttcagaattttaaggaaaagcatatttcatacgttgaagtcataggtcccttaagacaagttctattttggtatctacatttacaatggctgagactgtcacaatcgttcaccttcatcattaaaaagccatataaacttcctttctcctctaaacttagaatgttaaatgttggccttgtaaactaactttctaagtcctttaaggtttatgtccagggatgtagaggctaggtaaccagtaaggcaaggtcagatcttaacaatgcaagaagcctcccaaacttatcctttttccaaaattactgtgaaaagcaaacttttcataagcccattatgagtacttctggaataatcacttatgacttgtataaagactattaatagtttttaaatgaggtggaaataggaaatggcaacagatcatgcctatgtggctcatccagctagccctctctagattagctttggttcaaacctagaggagtccctctgtgatgcatgaatccacaggatctgtgcctgtctcaaacatgtctgaatgctggtgtctgagaagagcaaagatttccattcttttgaaaggagcttccagtacctaccatgttgctctgttgtgagataccctctagaggtggtgctgagggaaagccattgtgctttcaagtcactaaagaacccgatgtgagagacataagaaaaactcacttagagatgccacaagccactaactacagtggattctattagccattactataaagggttgatactcctgacttggagctactaaaggaagtagtccctgaaagttaataaaaaatcatttagaaagccctccagatgggactcatgtccactactaagagtgaacagtaactggagccattatcactgtgagccacaaccaggaaaccatagatgaggcaggaggaactttccagccccttctcatccccttccctaaataagaggtgccaatgtccccttatttgttaggaattcagaggaaagatggcaaatattgtcctttcaatatactctaaacagagaggaaaagaattttttctgccaataaatgtggtatagttggagactcagaaactctcaatgtgggctttgctggattaaagaccttgagttgtagattgagtttcagactttttttaagaagtaaaaatagagatggggtctcaccattttgcccagggtggtctcaaactcctgggctcaagcaatctgcctactgcagccttccaaagtgctgggactaagggagtgagccaccgtgcctggcagagtttcagacttttgataattaaagtaacatttattgatgctatactgtgtcatccattgttctattttatatggactcagtcacttcatctaacaattctataaagtatgtgccatttattaacccattgtactgatgaggaaaagtccatagaagttaacttgcccaaggtcaccaattgtaaatggtgaacacagacaggtaaactcaagagctatgctcttgaccactgcttgcacagtgtggtagacagaaaaaatggcttctcaaaaacatcctaggctggacacagtggctcatgcctgtaatcccaggactttgggaggccgaggtgggcaaatcacttgagtttaggagttcaagaccagcctgggcaatatggcaaaaccctgtctctactaaaaatataaaaattagccaggtgtggtagcacatgcctgtagtcacagctacgcaggaggctgaggtgggaggatcacctgaacccaggaggcaaaggctgcattgagccatgatcatgccactatactccagcctgggcgacagaatgaaaccctgtctcaaaaagaaaaaaaaaaaaacctaattattcagaactgtgaatatgttacattacatggcaaacaggactttgcagatgtggtgaagttaaggaccttaagatgagaagattaccctggattattcagatgggctcagtgtaatcacatgggccttaaaaatggagaatctttcctagctgcagtcagagggagatgttacagcagaaaaatggtcagagaggttcaccattggtagctttgaagatggaagaatgggatcatgagcctaggaatgtggacatttcctagaagctacataaggcagagaaatggattctccccctgaagattccagaaaagaatgcagccgtaccaaaacttttattttagcccagtgagacctatgttggacttctaacctacagaacagtaaaataataaatttgtgaagttttaagccactaggtttatggaactttgttacagcaacagtagaaaactaatatatattgccttattgaaaaagagggttaatgattcccttcctatgggacttgacagaagcagagagaatgcttcatggtatgtaaattaaacttgaaattaaagttgctgctacttttatctcctggttttatgggttattatataacagcagttttatgataaagttttatgataaagctatgcaataataagctattataattcttcattttgacttacattagtacattacatagctagttttaaatgtattgcatcataatttgtccttcatttagcattctgccaaatgttataagaaactgaacacatttaagatcttgctagcggagttgaaagatttgtaagatgccattatttgtatatttgatacacacaagttggcttcttgttgtttggaagttaggagatagcttttcaccaaacagtaggaagttattgtttctaatttttagaatacaaacagactgattatttcccaccaaactctgtcatcagtgccaaagtattctttaaaatctcaggataaaatgagttgttacaatgagctttttcaaagcagggtcaacattttcacattttcacatttctcatcaatgttcatcataaaagagaccacaaaatgggtttagatttatctggtctctttcatatagcaatgtttatatgcctaaatacaattaaaaattaggccactgacctttgcaggcagtcttgggagatatttcacctccacaaatagtgaatgccacagaccatgatcaaacaaagcagtcattgctttctgcttggattaatgtggcagtatgctggctgataggatatacttggaaaaaaggaaactataccaacgggcaggaccatttttttagttaatgaagcttattgattgaaaagacataataaagtgaaatcataaaactttcagaaaaaagcaatacatgctttggaagactcaggccaccataagagtaagcaaagcaagtcttcagaacagaggttgaatcctccagagctatgtgatgagtgaaattaaacctgccacagacaccacatttgtattctttcagcagtcaggtgtggagtgttgctagttcctcccagcattgcagatatgatgaccttaattcagcttctatgatctggattcatacaaacattattaaaactgttcctgtacaatgagctaaagaaaggcaatcaaaattaactgagtagcagtcattttgactgctgagataaaataatagccaaaaacaacttcacttccagcaatcagagatgtagtggcttattttgggcaaaagagtcattctgcctattgtacagagaccccagtagcaaaggaggggctaccaggggaactgattgtatatatagtctcttcaaatgatggaagatgagagctatttgcccagtgtggaaagaaccatggggattatatttgttgtcacaactagtgccattcactggcctggttgattaatcattgagccttatttaactgtcttttttcaaacaactagttttctttttcttttgaattgaccatttttacagctgaattggccaacgctgttaaagcatcactcctgagtgccaccattaacccaaattttttaagtttgttttattttcttaatcttataagtagtgcataatcattgtagaaaaataagaaaacacaaataaggaaaaataaaaaaaaatctgatgtcccattactgtgtattaccactgttaatgtttagaagatatccttgcagatatttgtccacacaaatatatatataaacacatttcagcaaaaatagcatcctaccacacacattgttttataacctgcttgtttcactaaacatttgtgtacttctacatcagccatttaggacttcacttttaatgaccacatatcattctactgtatggatttactataatttctttaatcaatgccctgttattagactgttaagtatagtttgtaatttttgttattataaataatactatgatgaacatattagcacatgtatattgcatatttgtccagttatatccttaagtcctagaagtctaattacttggttaaaagttatacagttttctagaaattttgatgcctatctgtagtgtcatctctaaataagaaggaaaacagattaaaatatgaaagataaaaatcattcaaaagtcttaataggtttcataaacttctgaaaagccaagtgaaaacacaagtagaagtattttagtttgggtctgttaccacttacacatacacacacatatacacacacacacaaagttatgagcttaagtgagtcattatgtttacagatcagcaaataacatgcttttctaaataacaagcaagaatatcaaaatattgtcttctattttattaataatgcttaggaataaaaaactattaacagttatattgaaatatagttgatattctacaatttaaagtgtacaattaagtgatttttatgtgttcagagttgtgcaaccatcatgattatctaatttcagaacatttttactatatacaaaaagaaactccgtacatgttaacagttactccccagctactggcaaatgctaatctgctctctgtttctgtgcatttgcctattcttgatatttcacataaatggaattgtataatatttggccttttgtgacttgtttctttcactgggcatagtgttttcataacgttttcttctatgttgtagcatgtttccatactttattccattctattgccaaataatatttcattatatagatatataccacattttgtttatccattcatcagtttattcttggaatgtcaattaaaatcttatcacaatcatgtttaaaatctttcagtagcacctgaaattagtaagaaggtttatgaaaggccatcttaatcttgccctaacctactttttggcctgatcctctgctgcgctcccaatcccatccactaccacccttccatcagcactccagccatagcagaaccacttgaaatttcccagatataacaggcacactcacttatgtgctgtcccctctctctgcaatttccttcttccccttacctgtgtggatgacttttgtgtgttctttgttattcagctatcaggtatcttctcctcttggaagaacctaacacacaaatataagctgggtgcaacatatttttacaatctgttatacctctatcataacacttgtcacaatgtttataattattggttttcttgacttctcctccactagattgtgagctcattaaagtcagaaactatattctgtctatctctatatcatgagccatccaggcctagcatgtgatagacattcaatatatgttttctttctatacatggtcaatgaaattaatttgactttcttataaactgcattaatcaatttagggattttataaccacatagtcataaactttatttaaaatgcatgttccagtttgcttatgtttaatttgttcatatacattttatattaaaattctcagtaacatatgaaacaatatgcattaaaataaaccagtcgtatatataattctagtaaagcttttaaagtatacaatgaacttataacctatcaaatagagatactttttcaaataccttcaactgcctttaatggagacatagttaagtagaataactgaagacaaattcagaatttatacaaaaaatgattcagcatcacatttcaaatgatttaaggaaaaaatcattaagaatatgccatgagatcaatttataaatcataattgcactttcaaaacaagataagcttctttttgcaagcaaaaatgttgcttctcttaaacttgacttggagagtgctgccttgcttaaaatactataatattctttgaagcctacatgcataaactgtttctggatctgttttcactgttttctatgtgaatgaagatttgtttaagtaggcctggttcttggtaatagaatcctaacctctgttacttctgacttatagggtatctttgttactagggttcagcctgatgggccagcatcaaacctactgcagcctggtgataagatccttcaggtaagacagataaaagaaatgcatgcaaatgccatactgagacaaatatgtaaccatgttaccaagttaaatgatttgaattaaatgattgaaaataagtccttctcacattgcttatttgcctttattattttggggctgaaagtcaagtcaaaaacaattcagtctgacaaatcttatatccctagcaccttacacagtacttggcacatgacagatgttttgcatatttttgttgaattgaatggaattacttgataatataagaaatatatatattatatatatatattaatctatgcatagttatcaagtaagagtaagttcccaaacacagtatgtgtgtgactttcatgagggagaaggaactggtccatatttaatttctcaaccacaggcttattactgtttgaatgctatgaaatatataatacatcattctactccccctgcttagataaacaaaagtttagctctatataaggtgacttttaaaaatgcattgtgtgatggaagatgactttcactaacttaaagctctgcatatcagaaaaggttcaccccaataaacaattaagcaaatactttacataaactcatttatttgactttttttgtccttctctctgaattcactgtctttaattttttgctttgtttcttatcagtgatttgaagctcattaattcacttcctatataagaggtgcataatcattttctacattccaaggaaaagctcttaagcattatcgatgtatttaagcttcagtattttgacttagaaccccagaaatttcccgttatataaataggtggaactacttgatactgctgatatttgaccatctgcaacagttatgaaatggctcaacataatatactgaacatttagattcactgagaagacaagacatgtgaaaagaaccttagatcagctatacaaacacagttgacatgtgaaaaaggaaccttagatcaactatacaaacacagtttaaaaatgcaaggatcccctcaagtcagctccaaggagatcttctatctccaatgtactgcgttctctcagaaagtcctagaaaagtagaaatcctaagattgctttaacatttcattctcagaaatgttttttggtttttttgttgttgttgtttggtggtggtgttttgttctgttgttgttgttgttttgtttttgtttttgtttttgttttgagacagcctttcactcttattgcccaggctggagtgcaatggcacgatctcggctcaccacaacctccacctcccgggttcaagcaattctcctgcctcagcctcccaagtagctgggattacaggaatgcgccaccacactcagctaatttttgtatttttagtagagacagggtttctccatgctggtcaggctgatctcgaactcccaacctcaggtggtctgcccgccttggcctcccaaagtgctgggattacagacatgagccactgcgcccggcctctccgaaatattttaaactaattagcaagatcacaatcagctactcaagttttcaaaaatgatagttctctgaaaagtgtttaagctacttcagcctgtgccaatgtcacaatagaaacaccacccagcaggcctgagttcattctatgcaggcagaagatgtaaatagcagttggtcttttgagctagagctgagaaacaataaaaaccacacatataataatctaaaattttcctttaccactttattatggaagttctatatttttggatagcctaactagtcctttgatcttagatattttaaataatgtctatgggcctcaaattcattatgtgtaaaatgaactgctgtttatattatatctgaaatccctcctagctcaaaaattcaactctttgaaaattgtatgaattgtagtgaaaaacagctgagaataaactaacaacataactctctaacatttggtaaatgctgctcattagcaaaggaaatggctaatttttttctccactgaatttcaaagaaattattttaaatcctagagtctggaaaaaaatatagccaattaatctcagatctcttacctactagaatgtgaagctgggtagagaagtatgctatagcttgacacaacgttgcagagttccttcctccatgacagaagcaaaataaagatttttcccttttgctagaattcagaaatgtatatgtaagtattataacaaaattatacacagtatatcttgcagatggaaacataggttagtgtcaggccagacatgatggctcacacctgtaaccccaccactttgagaggcagaggcaggaggatggcttgaagccagaagtttaaggccagccttggcagcacagtgagacttggtctctacagaaaatttaaaaattaaccaggtgcagtggtgagcacctgtaatcccagctactagggaggctgaggtgggagaagtgcttgagcccaggagttggaggctgtagtgagctgtgattatgccactgcactccaggcttagtgacagagcgagaatctgtcttaaaaaaataaaaaataaaaataaagacattagtgtctacttgcaaggtattagaatgctcttttctggctatgaaattctagaattatatgtggggacgtgagggttatgagggttcagtatttctaatcctggagaggtaaaaacaacagcaaagtgcaaggaaatggattcctcatgcaagaagtaggaagaaattttcagccaagaatactgcagaaaagctgcacccaagatgtctcttctctccacaaatgactatcaaggatgtgacattttatttttgccatagaactcacttgtacctagtccaataaaatcaaagcccattttcaataaaggaaaaagtacatggactttaatcaaataaattatgtatttacagtttcagtcatactaattaaaaagcatacatggccaattatactttctgaaagaaacgagaatggctaattctaaaatgaaattgtttgcaatatcagatgctaagaaggcaagctatatatttatctatatataatactattgtctcttagtttaaagaatgctgggaaaaaatgggttaataacattgagttatctatcacttaaaagatcagaatcttgtgttttcaatggagcgaatttatttacaaagcttaatggcaatgttcaacctggagaattgaagtaaaagaagagaaaaaagaaaagaatggccctccctaagtgacaatacttttggggtttaatctaacccaatagcaaatagcaaaagatatatgagagagcacaagagatatgtctttcctaatccctcttcccaaacccagaatttattagatctctttctttctctataattctttataccatccactcttttcttcttcagctatgatattatgagcatgttatttgaattacatgaagatgtgtgcaataagggatgatgttaattaaaacacattcacatcatttttctgttgtactattcattttcccggaatagacacattataattactctaagacagtgtggcatatggaaagagcaactgacccttcatagactcaccttctgttaagttcaattatataacagtaagagaaaaaactgaaagcacatggaatataaaaatatgctagaataagccatgtgaatttgccaatatttgaaatgacagttttgttaatttatcgtcatagtttcttttttctaatgttctttccagctaaaaaattcagtctaattcattatacattttatgattcaaaatatatatgaatacagaaaatctagtaattatagttattctgttgaaaagatgaatagactggaaaaaaatacatactgtacctgatagttaacaacagattcacagttgtaacctaaaactcactcgcaagtatgtcctgttcaatcagggaagccaaaccctctcctcttcatttacccacccccatctccatacataagcctaattttggcaagaaagagaaattatataatttatagagatttagttgatgacatctagattttgccaataaccaaaacagatttttctaatatgagatatataaataaggtacttaattgaagataattttatagtctcttttaccttgtcatcattttaagggttttggaatttgcaatccaaacatactctttgtctatggctgtatttcaagatgctaaaagggaataatcaatgagataataattcaaacaagctagatatttttctttttttcttgtcttagaaagaaccttggcccaacaattcatatagacagttcaagaaactactgtcaacaataagtctatcaacaaatacttgggctattagcagagtcattattattgcactttttttacttttttaaagttagtttttggtaagttgttcagctcagagcatcttctcttggccaaaatcatggggtttgatgcccattagacctattatcattgctctgttctataatcactgacaattccactccacatcctgattagtgtcttataagggaatatcattagaagccccttaataggtaggagggaagtcatgtgtcctaagggagctaatagctagggagacaaggtgaatgtatgcactcattaggaaactaataaagtacttgattttgtgatgtatctaataaatgttgtagctgtgttaagggaatggagtgattaatataaaagtgtgtatcctgggatgcagagaggatggccactcacaaacaaaagtacaagatgtaagaccctcctcttcttacctcctccagtgaatcactgagggagagggagaggagacctgtgtggcagggtgcactggggatcatggagatctctggttgtggagggaggtgaaagaagggagtttattcctggtggagcagaagttcctccaggcttaacagaaagaaaaggaggaggaggaggaggaatatctgtgggctagactggcatgagttttcaggagcaggggtaagaggtttatgctagaaagggtgaatatggagtataaaggagagaatattggagaggaagaccccagactcgtgtgttagagtcatgaagaaaggaaaccctgggattttaataagtttttcatggactgggagaatttcaaacatggagatgagttggagcgaggctcaggatggcgatagggggagacagcgagcaagatatggcattcaaggctcagaatgggagaggtaagttcagactccacaaagagaagtctaaatgaaatgtctgtctatggctggatctgttgtacacagatatatatacaaacactgaatcacgcttccttgtctgaatggaaatttgatggctctcttaatgaccagtaggtgtgatcagcttgctgagagaattttcttgcttaggtaaagctcacttattcaacagcctcagctataagaaaaaaaacataagctagaaaacaaacaaagtgcttctgaggatccataattaatgtcacaaagcccatgcactaaatctcattccttttactcataagagagaatttatatcatacctgggagtcttttatctagttgtccagaccaccaaggtgaaagcctttggctccagactcattgccagaagcaagaagtcatagccaacagcttcactctgcagtaagagagaaacttcttttaaaagcgagaaacagaagagaacaacttcttttgaaagccagaaacaagattttaaaagcacattgtacttttaaagtaaaagcagattgtacttctaaaatcttgtttctggcttttaaaagaaagttttgtactttcagtatagaacagttttctcaatgacattttttgacatatcttcaaaaaaaaaaaagagttcatggtcaactaagttttgaaatcacttcatactctatcccttgtttcaggactttacactgtactaaacaggctaagaactctgagaattcttacagatatatttttcaacatatttaaccatacagtcctctttaccaaagcatcaattaaccacttccacacaacacattttgggaaatgtttgttacagaaacaaactaactgggccatgtatgtgcctaagagagtgttgatgttcacagttattaccgtaaatcattaagaaatggttaatgttcattttctgaattttaaaaaattctttaaaaaaaatcttccaaaaaaaaacctgaagagtgagaaattgtttatggttaaaatgaagtgttggacccttaaaaaataaaatatttaaaaattgtactaaagcatttcccaacaaggccaagtaagttccacatttctatagtttatcttatttgtggttaaaaatcaaaagcaccagagacactgagggtgggggactatggaggaataatcacataacttttaatgtttaggtaaataattgcttataatgatataatacattgaagagtaagattttaatacaattggattagaagggaactagaaataggttaaaaactatgttgatcaggcacagtggctcacacctgtaatcccagtgctttgggaggcagaggcaggaggattgcttgaggcagaggcaggaggattgcttgaggccaggagttcaagaccagcctaggcaacatagcagaccccgtctctacgaaaaaaattaaaaattagccaggcgtgatggcacacatgtgtaattccagctactcaagaggctgaggtaggaggatccttcaagcccaggaggttgaggctgcagtgagctatgatagagccattgcactccagcctgggttacagaatgagaacccatcgttaaactgtcttttaaagtgtggttttatatgccagattttgactgcatatttttatacatttagttttgttcataatatacaaagttcttgcacagaaaaccaataaaaatgttgaggaaatgctttttgaaaatcaaaaaatattttgagttatttagtaaaacatgaaaaccaataaaacaaattaagttttttaaggtgactctatccttcatagtttagttaatagaaaagtaacatccattaagtgtctttattgtgtcatttaaatcatacaaccctgcaagatatctattactgacagatgttcgataacttatttgagttcttccattgtcaacaaaataacaagcagagagagactctttaaaagaaaatggtgtttatttgggaatagagcattgaaatgggaatacatatgccatagtaaactgtgtatgtattcaggaaggtaaagaaagacaacggtttttaaaggaaaaaataaggattatgtaactacttttaaataattatccttgactacaaagatcaatagcaaggatgatgccagtccaagactggacaaccaattgctgggcagatgtccctgcagaagcattttttgtgtaaggttgcaatggtttttgtgtaaggttgtgtttttgcagtcttttgtgatagtttttgttatcgttttgtatatctcatacttgggtatacaagtatgagaaccctctcttcatggccttccccgctctatttgccaggttttttgttttgttttgttttgtttaacactagtcactctatttgattctgacaactttcacaccattacgcaatactgatttctctggagcaaattttgctgatagtgtcatatttattacattttctaatttatttatttacctggaaaatgtgcatcaaatgcccactgtgtacaaagtattgtgccaagcaatgtaaacaatgttatatgaatgtaaccaagttcctgccttccacaacctagtcctggaaatagacatacccaaattatacagagcaggaacaaagcaggaagagagataaaaagagctgaatataaaacatttgataaaatgaacctgtcatttaagagcctgataaaatgtcatttaagagcctgataaaacatttgataaaatgaacctgtcatttttatcaaatgagcctgtcatttaagagcaagctcttcatcaaaatggagaccagcctggctacaaagagccccctgaaaattaggggttgattttgcagttattctttttgtgaaaagtaaaaggaatgtggcttgttgggaaattggcttgcaaatcaaggtaggaaatttatttgttgaagatgatcatttgatatgtttgataaaaagaaaacaagcattcaaaaatcagagcagataaataaatttattcagatttactatttattatcagttccacacctgagtttctattcaaataattcagtcttcagttgagtatattctatcttgccatatcttttatgagccttaattcatgagaaattcaagctgcagtacatgtgtgtacttaacacagaagagaaattcttgctgggcgcggtggctcacgcctgtaatcccagcactttgggaggccgaggcaggcgcatcacgaggtcaggagatggagaccatcctggttaacacggtgaaaccccatctctactaaaaatacagaaaattagccaggcgtggtggcaggcgcctgtagtcccagctactcgggaggctgaggcgggagaatggcgtgagcccgggaggcagagcttgcagtgagccaagatcgcgccactgcactctagcctgggcgacagagcaagactccatgtcaaaaaaaaaaaaaaaaaaacacagaaattcttatttatgttttgttctgcaaaggttttttttaaatactagaataaaactcattaaaacttcaaactttctcacatttacaaaagcaatgtaaatttttcatatgaactctctaagaactgaacgtctataattcaggtttttgatagaaaggaaagttttttaaatagcttggcatagagtcaatatagtattgattatggagtatactcagccctaaatatatcccaatacttaatgagagtactcttatcagattaaaatttgaaatgagaattaattctagttagttaatgtgaagcacaatgaggattatctgagattcctgctctttctcataatacctggcaatcatcattgaacaccatgaaggcttgctcttaaggcactaatttggtcactgcattatttcattttccctcatcctaagagctgtaggcattcaaagtgcaagatatcaatgtactaatatttctctaacatacaaaatttatgtgtactggtcctttaaaaaggattatcctttgggtggtgaatttaaatcaaccagaaatcacatgcccatatctctaagctgatttctttttttggagtttaaaatgaactgtgctgtcctccctgttggataatcccaccaaccctgtggccaggccttctctgagctatttttaagcttagagctttggataataagaatgcaacagaatttctaggaaaattacaacatcatctggactgtttctgcaatataaacatctataatttatccatttaacaaaacatttaccagaaggtaatcaaacataaatccaggagagaacaagagaggaaattcagaaaccaagtgtgttttatgatagattgatgagctgtaattgcaaagctctactttttgttggaattgcaaatactattttcattaaccttcagtcttttcatgtctaaatcatgaaaagagacaattaaaaaacattttgtggcacagaagatatcaaataaaaaattaaataaaggagagagagcttctggaaataatgtaatgattatagtaaaatgttccttcatactttcaaatcagctaaagctagaaacccattaattacatattttttaaggattaaattttcagaatatcttttccctttttagattgttttcttggtaacttcatttcaacttaagccatttatttctcatttttcattaggttgcaatttcctcaaaattgtacacattttattcaaatctatgatagtgtgtttatataaaacatataggtagccaaatgcagcaataaaatttaaattttttattaatttaacatttgttcttcaaatcgtcttttgcatagtatgcatgtatttactaatataatagacatgcacgtaaatcatatgcatttattttttcaaagcatcattgggtttataccctgcaatgaacattgcacagtaccaccatttatttcctcagcctcttcttctatgcacacacacacacacacacacacacacacgcacacgaacaaaaatgcaaaactccattagttggaatattgtgattcttctggtctttattttaactggagaagccctacacgaatatagtaacatagttgtttgattccccgtctgaactatccaagatgtaagcctgataaccacattcattttaacaaatacaatgtcaattcattttgctcttctgtcctaagaaagagtaagtttctttggaactgagatttattctattatctccttccactcaaaaaaaaaaaatggagattcagcatttctgtagatttttaacttaggactaaatgttatttctaccaatatttttagaataagttaaattaaatgtgatagaaatctgaatgggaatcatagtttggcaaccactgtaaagagcagaattatctttggaggtgatacagcaacaattttttaagggaaaaatgttcattattttatcatgtccagtgaaatgtcagctcaaattacttgacatgattgtggtcttattatttcaatgaagtaatgaaagaaacaagaagaaggaatattatgttatcaggtgattcagccttagccctttccctggttgtatgacctcagacaagttgtttggtctccttaaaatgaaggtctttcatttataaaatgacaggattagactaaaccaacaggtttcacactgggctttcatgaacaatggggggtgggaaggtattggcaagtaagctggttcactggattcaatctttcttccacctctctccctttctttgtctctctctaaaaagatctgtctaaatgttctacatattgggctctcttccttttgaagaagaggttttttgaactaacaccttgtttaaaaaaaaatagcccctctatgtaagtttatttttatggttgcttcccatgctaaagcctatggtctaaagtcgcatgttttggatttggtgcttttttttttgtttcttagaaaaatgattccacacatgaaccatttttgaacgctttattctgcacatactgttacagaatttacctgaaaaaaaaacaactgttaacatactgagggctcgaggagactctaggaatgagacaagacaaggactgtggtcctttgggaatcacacttgttctatgcctcagtgaaacagcaaagagaagatgtccctctcttctttgccctcctctgaactactccagcactttatttccgtcttcagatattaattcaattcagcatatatgtactgagggctcattctacatgcggcattttatgttatttttagttacgtgcatgacttatttccccttctgaatggctactttttgattggagccttcctgtttcatctctttcttactacccatccccagtgcctagcacaatgcctatggaagtgagtacaaaacagacattctttaaaaaaaaaaaatgcttaagtaatcacattgagagccgactaaccttctttgaagatctttcatgataaaagtaccactcaaaattaacagctatgattaatttgctaagttttataccaatttcgcccttaacactgatatttttaacattgatacgatgtcaagtatgatgatgaacaacataccattcatggcctccaaatcctagaaaattttttatttctttaactgtgagatatttaaattttgaacaattccctgaaaattctcagtggatttttaattcattgcaattctaggtttgagtctgcagatagagaaatctgagcactcacaaagtcactattatggtttgacaatcaagaactccattattaaagttcaattttaatttcacaattaagttacaacttttggtcaaattgaaggcattaaggtattttggtcaaattgaaggcattaaggtagtcagtacatccctcaaagctacagtggaataaataattatttcatgcaagtttgctatgttcctgatgtctgaaacaggttaagagtagaaaaaagaatggcccatatgctgtattctttactcttcatcaccaactgatcagaaataacatcaaatgtaacctcattgtctgatttttagtataacgcagagcaagaaatctgagctgtgtaacacacccaaacttctactcaactactgtttcctgacactgaaacagccaatgccaacttctgtgggcattttcatttattaaatgttgttaaggaatgtatttaagatttctttaattcaaagcaaatttttacttctaattacatgaatttccaagaatttatattctgtcatctagtatttttttactggcagatttactatggtttacaagtgtaatattttggaatcttctttactacatcattagtcaatcaattttaatgaactagtgatgagatataatgtatcatataactttcatctaagttttaaaggctgtatggcatttctagagatataatgctgctttaaatttgaaaaagctaaagtcactgaaagagtctaattattaagtgattggttatctgaaatattaatcatattttaagaaagcataaaaatagtaagtaaaataaaaaaggcaatgtgtaaccaaaataagtatcagtccattgaaaattgaagaagtcaaccagtgaactggctctgttacctctattcagccaagctgtcaacttgactgcctcttttcttaatcaactgagtctcaaaccgcaaagaaagcaattacataaccatcagtcattcagttgccaagatttatttctatcaagtttcaataaggttgtatttagttttgcctttacggcagtgaaggcttatgggatacacttctttctgtattaataataaaaatcattccaatcaagacaatctgcaacttaatgtagagaaaatcagagacccatagcactcaatacagagaacaatgtacattttgtgacataaatatcacataatagacagatggaactctgaaactgtaaccttaggctatgtttaaactgaatatcaattgcttatatcaatgattcttaaacagaagacagcagacatgtcctctgttactaatgtcagtgtgttttatccccaagggacgcattccttaagtatactggattgattgagaaccactcctatagataataagtatacttgcatttagcaataagggaaataaaaaatatttctctaatgtaaaagtgtataaaccaagaactttccagtgagtcaaaataagatttaaatgtactataagtgtccagtcatgtttggcatgattgaaatatttggtcatgctgattagtttatattagtgtttatataacactaaggtaatggccatatgcccctttccaaaccaccctaatcagcccctgcaaaaacaaatcaggacaacaacaatggaactgaactactatgtcaccagtacatctatctgttattgaccagggtatcttgatgattagcacagtggcaaagacataatcggtacttaataaatatttgttgaattgataaatttggttgaatctggataaaattagttacttccataattgcgattccattgtgaattataaaaactgacaactttttgttgctcagtgctcccgtgaattttatgaatagaaacaacgatacagtgataatagtttacattgattgccctgttttatttgtgtatttacaggcaaatggacacagttttgtacatatggaacatgaaaaagctgtattactactgaagagtttccagaacacagtagacctagttattcaacgtgagcttactgtctaaatattttttataaatagtgaagatacgtctagccagacctaatgttcaaaaataaatttatacatagaaacaaattttgccaattgctggaccaatggcaaacattagtgccaaatgtataatactatatgttagcactgaccatccttaaaaaatgttaactctataaatatgatgttcatgtggttatgtattagttttaattgtcagcctctggctgtgcattggtgcagttttgtttctgtttttgtttttgtttttaatcaaataagtttcttctcaaaatggatttcatataatttcggagcacggaagcacacacaagctctttatgaattctgctctccatcagaaacactgcctcaaagttgtatatgcctttatatagaaaatacaaatataaagaattgtaattcccataaaatatttctagcacaaggtatatgttggcatatatacaaaaagaatatagagaaaaacaatattttcataaactaaacatctcagatagagaaaaaatatatcttaaaataagactttactatattgaatctttttcaataaaaattacatgataatgccttatgaaagtaactgtacatatggtataaagtgtttatatttggttccatattcatttgctaaattctcatgacacagagtgaaatatttcataaattagccatttatctctgggacccaaataaaaataggatgaactaatttgttcaatgcctttagctaattacaatacatgcagagtttagaaacagactaaaggtcattgtagttaagtctttttcaccacaaatttaagcagtggatgatgggtggcaggaaaggtattgctttatttctttcaagttcatgttgattataaactgtagcccctgtgatttctttacttgtaaatgtggaatttatttgtgtgttgcttaatctaatttgctgctttttaaattatttaaaacgaattttggaaattgataaaatttatcattacgaaagactgctgttagaaagttatggtaggtgattttaaatccttggtatttaaatatgaaacttcaaatataatttctcagagctgtggtctacctgtatcattaatttcaatggctgtttttctgggcagaaatagataaaatactttttttccaaaaacagtttcaaggtatgtaaaatcctgaatgctttttcactgaagagaaagacaagcatggttaatgtagaattatttacttttccattgaaactattttcctgcataaatgatcaaaatttattttataatcctttaaaatacttatctttcatattagtcattaatttaattacaatattaatttgaatttccaggataatttcccggagttggttgcatgcattatctttcataattttacatagttcttttgttatataatgaatttactttacatgctagtgtttcaagtattgtatgaggattttcacaatagtatcactgaatgatgtcaccagagctctgagaataatatttgtaagttaactgttttatggggacattgaaaatattgtatttttgtagggtctattaaaatgagtgtcacttattagaa

SEQ ID NO: 184 - DNA, 997 bp, Homo sapiens
actttatttacaaaaacaagagcgtgaggaggaaagatggcggacgaggagaaactgccgcctggctgggaaaagcgcatgagccgcccctcaggccgagggtactacttcaaccacatcactaaccccagccagtgggagcggcccagcgggaacagcagcagtggcggcaaaatctggcagggggagcccgccagggtccgccgctcgcacctgctagtgaagccagtcaaggcggccctcgacctggcggcaggaaatcacccggaccaaggaggaggccctggagctgatcagcggctacatccagaagatcaaggcaggagagaaggactttgagtctccggcctcacaattcagcgactgcagctcggccaaggccaggggagacctgggtgccttcagcaaaggtcagatgcagaagccatttgaagacccctggtttgcgcggcggacgggggagatgagcgggacagtgttcacggattccggcatccacgtcattgtccgcacggagtgaggattgggggcccaggcctggcctcggggttcccccgctgcctgctggccagtggccgaaccccccactccctgccactgtcacacagtatttattgttaccaaaatggctgggagggggcccttccagactgggggcccttccagactgggggccctggggttccccactccctgtcagtccccagttggggctgcgacctccagactctccattaaggagttgacttcagcatgggagggaggctcgcagacccagggcaatgtggtgggaggagtgttccaaagagaagatctggtcagcagagccgccccatgtcccaccaggtcctggaggcagatgcgagggcccagagttgtttgtagttaggccacgcttctctgttcagtagcaaaagcaaacactcgtgggcccagctgtgggccctctgagcaactttgcagcaccctttcacccccaattaaatccggaaccact

SEQ ID NO: 185 - DNA, 55724 bp, Homo sapiens
tttggcatttttaatttaggtttgttttatttaagtttaatgttaattccatgctgtgtttcagtaagaacaatacagattctgtatctgtggctccagtcagatatccagtagtacaaattagcttcaagttacacatactgaacaaaagaggttgagcgagcgaaggaggggaggagtgaggggaaggaggtagggggagggggaaggagaagaaacaaaagaattgaacaggcatgcaggcttttccataccaccttcaacgctaacctgcttcagtgggagagtaaagtaggcaagaatgagcagccacggattgttgaactgttaccagcaccatgcttttcagcaacatttcagcggagttggaaacattttttacagcaaaaccattacaacgaagtccctccccaaaccacctttaaccatctcaagctaacacccaattacttgcaaacactggtataaaacacagtttaaacaattagaaaaatgaaaactgataccacttatgcctctatagtgtgattaacctctctcttagatgcttgcatcacctataagtctaatggctttcaaatgtaatttccatttgctaatggtgatcttgccacatctggcacggagacgacacagtaatgctgaaaaagcctctatgtagtcctgttagtgtcttaaagaacctaaaagctgggaccagtaaaatccacagaaattcactcttgcctttaagaacttttgaaaactgtttaaaaaaaaaaaaaaaaaaccaacagggcaggaacctaaattctgagaccaaatgtaaaagtcagatttggtggttctcagtgacaatggggagtttccaaagggtgggatggggaggagggggtggtcagagatggtttctcttgttggcttatgtctcactgattttcgtcttccacgtcctgcagcgcttctttattctgctcttcacctgttaaaaaagaaaaaaagtcaattatttcgtattgactacattaggctatggcagccacaaacaaaggtgtcattccaagcataaagactcttctacttgctacaattggtattaaacgcaggcaaaggacttctatcatccttgacacctgagatgcctaagccaagaagggattatggtcctgaaagtatttattggtcaacagaatgaaaaaaactgatgcgcagtacaactcaatgtttttacgctaaataagctcttgacgtagacagccaaggaaaccatcttactaaaatgacattcaagctttcacataaatcttgggtcaaaatactctttctcaataacctcacctcttcaagaatcaagagtattttgcaaactttttgcaaaatctaatttacccacaagctaattatcagaaatgcttcaaaatagttaactgagcaataaactgttgccaagaagttctatcgtattttattgtggggttctgctgttataaatatttcagcttttgtatcttggccagatacaccaaactataatcagattttacttcagagtgaaacacagcatgctcaaagtaaatcagaccactgaggttattaaagaatggcatttggaccacttcactcatgctatttgtcttttgcctttaaagagggtgattaccctaaggagtttcaactgcactatgacatgcaacagaaagccacctattggttggagggtcatctacctattagtatgcattaaacaagtcagccaaaataaagaagcatgcaggcttttcccttaaaaatgatgtaacaggtaaaagttacattcacttgtacttttttaaaaaaaccacttacaattactacacagttaactagtttgaaacaaaataaatgaaaaatcaacccaagaatcataaatgttcaaatgactatccattcataatgcttgttaaattatttaattaggatggacaaataacaccaaactagctgcctacacacatgaagcatttacactgagtacagctttgaaacagcctaaatgatctcaaaatgacaaatgtcacagcatcaaggtttcagtagttttcaaatctcttctgcggcggaaacgcttgacattgctgtgtgacttcaaaacccacttacagcctcagcaacacagtgaagccctgtctctacaaaaaatgaacataacgccgggcacggtggctcacgcctgtaatcccagcactttgggaagcaaaggcgggcggatcacgaggtcagaagatcaagaccatcctggctaacacagtaaatccccatctctactgaaaaaataatacaaaaaattagcctggcgtggtggcacatgcctgtaatcccagctacctgggaagctgaggcatgagaattgcttgaacccaggagacggaggttgcagcgagccaagaacatgccactacactccagcctgggtaacagagtgagactccgtctcaaaaaaaaaaaaaaaagaataaataaaactaaaagtaaaaaactatgtatgctggagccaggcatggtggctcacgcctgtaataccagcactttgggaggccaagagaggtggatcatgaggtcaggagatcgagaccatcctggctaacacagtgaaaccctgtctctactaaaaatacaaaaaaaaaaaaaaaaaattagccaggcatggtggcaggcgcctgtagtcccagctactcgggaggcaggagaatggcgtgaacccaggaggcggagctttcagtgagccaagattctgccgctgcactccagcctgggcgacaatcgagactccgtctcaaaaaaaaaaaaaactacatacgctgggcatggggccacatgtctatagtcccagctacttggggggctgaggtgggggagttctatttctgcagtgagctttgaacgccactgcactccaggcggggcaacaagagcaaaactccgtctcaaaaaaatgtataaaattttaaaactacttaaaatacatgaagatctttaattcataagacagaaaaaaaatatgcaaaggcaaaaaaaaattgcttagggatgaaagaactgatgggcacccaactgttctccaaaggacaataacgtattcaaacgtaggaaacatgataggaacattcactctaacagcaaatcactgccaaagtatcattaacacaaacactagaacacaactcgcttgtaagcaaccatgagatgtgccagaagttccaagtaactttggcataaaaatgtcactgtcatatacatcacatccaaccacagtaggcaggaggagcaggccggaaaaggcttaggtcagcgccctggaaggtggaacaggcagagtctgtaagcaacaggacgatcatacgcaggcatgattagtgaagaaccaaaactgaaagcggaattcactgtgccatgaacgtgacttacaaagtagagtttttaggaaaggaagagttgggttttcctttaggaatctatattgcaaggaaaaagggagggagaacaatcatatgaaagcaacattacaagaaaaataaaccaacagagcaggacaaaggaaaacaatgatacaggagccggactttggtcttacttcgtgtaaacttcactctaagcaacaatctgtctactcctcctcccttctactctgagaaggaagtaatatcctcttgaaagacatacagatattaggggaaaaaggattccttggctatgtttctttgcccagtgtatctacattttggagagaggggaacaggcagggagaacatgtatttcctacctatggattcgtatatgaaacaatcctcttaccacagggtgaagagactaaaatcacttgagaaaaagcaatgatccctccctttaaagaaattatgttccaacatgctgggacagacattaacatattctaaaattaaaagacataaataccgtctctttaaaaaacaaaaaaatctaaataatccttaaactaaatgcaaagtcacatcctagtaaactgccactttcatgacgattctcctatattcaccacggaacccaagtcacaaaagtagtattttattttgtgagatgaagttttatcttgcccaagctggtgtcaaactcctgggctcaagtgatccttctgcctcaccttgctgaacagccgagattacaggcaggcaccattgcagtttcaaaaccaatttattaaaaaatgtaggccgggaacagtggctcacgcctgtaatcccagcattttgggaggccgaggcaggcggatcacgaggttaggagattgagaccatccgggttaacacggggaaaccccgcctctactaaaaatacaaaaaaaaattagccgggcatggtggcgggcacctgtagtcccagctaccaggaaggctgagacaggagaatggcgtgaacccgggaggcggagtttgcagtgagccaagatagcaccactgcactccagcctgggtgacaaagcaagactctgtctcacgaaaaaaggaaaaaaaaaaaagatgtaatactaggccaggtgcggtgactcgggcctgtaatcccagcactttgggaggctgaggcaggtggatcacgaggttaggagattgagaccatccgggctaacacggggaaaccctgtctctactgaaaatacgaattattgccaggcgtggtggtgggcacctgtagtcccagcaactcagagaggacgaggcagaagaatcgcttgaacccgggaggtggaagctgcagtgagcagagattgcgccactatactccaccctgggcaacagagtgatactccatctcaaaaactctaatttttgacaaattcaacttctcaaactgatgaacaatttctttgtacccacaattatttgtgtattcagagtttgttagttgtaccggaatgtcaacagaccacctgaatttttcactgttgaactatttcatgactggaagcattatataaataaaaagtatttcacctaataaaaattaagtgaaaattactcttcttaaccaaatttaatcaactgatttacagactcaataaggaattgaacacaaatgaatttcactagattttttttttttttgagacggagtcttgctctgtcgcccaggctggagtgcagtggtgctatctcggctcactgcaagctccgcctctgggttcaccccattctcctgcctcagcctcccaagtaaatgggactacaggcgcccaccaccacgcccgggtaattttttttgtatttttagtagagacggggtttcactgtgttagccaggatggtctcaatcttctgacctcgtgatccgcccgcctcagcctcccaaagtgctgggattaaccggcgtgagccactgcgcccagccgaatttcactagatttttaaaaactgcgaaagtattaccctgtattttttttttttggacgaagtttctctcttgttgcccaggctggagtgcaacggcgcgatctcagttgatcacaacctccaactcccaggttcaagcgattctcctgcctcagcctccccagtagctaggattacagacatgtgacacgacgcctggctaattttgtatttttagtagagatggggtttctccatgttggtcaggctggtctcgaactcctgacctcaggtgatccacccgcttcggcctcccaaagtgctgggattataggcgtgagccactgcaccaggccgtattaccctattttaagatgatccatttcctaaaactgtactcgacaaccaagaataaggattatctttagttctgtacatagactgacaggtagtctactttgattaatcaactcttggttatcagtgataatgagctacagaagtaatccagacttggttatgagttggtatcaaatgtgttttcttgttttgtttcgtttctttgagacagagttttgctcttgttgcccaggctggagtgcaatggagtgatcttggctcactgcacctctgcctcccgggttcaagtgattctcctgtctcagcctcctgagtagcagggattacaggtgcccgccaccacacctggctaatttttgtatttgtagtagagacggggtttctccatgttggtcaggctggtctcaaactcctgacctcaggtgatccgtccacttcggcctcccaaactgctgggattacaggcatgagccactgtgcccagcatatgtttttattaaaataataataataaaaaaaaatggccaggcgcagtggctcacgcctgtaatccaagcattttgggaggccgaggcaggtggaccacgaggtcaggagttagagaccagcctggccaacatggtgaaaccctgcctctactaaacaaacaaaaaactagctgggtatggtggcgcacgcctgtaatcccagctactcaggaggctgaggcaggagaatcctttgaacccaggaggcagaggttgcagtgagccgagatcgcaccattgcattccaatctgggcaacagggagagactccgtctcacaaaacaaaacaaaaaatcagccaggcgcggtggctcacacctgtaatcccagcgctttgggaggccgagatgggcagatcacaaggtcaggagttggagaccagcctggccaacatagtggaaccccgtctctattaaaaatacaaaaaattagctaggagtggtggtggcagacacctgtagtcccagctactagggaggataaggcaggagaatcagaggcaggagaatcacttgaacccaggagatgtaggttgcagtcagctgagagagcaccactgcactccagcctgggtaacaagagcaaaactccatctcaaaaaaaaaaaataaaacacacacacagaaaaaactttcaagtcaggtcactttcattacttattacttttactctcaaaaacatgtccccagaggtgagaggtgtatcatttcctgaagtcaatcccgcgccccaaactctccgcatgctttccctccatcaacaggcagagagatactagcatctgagctggggatgaccattacgagtccacagctgtttgaccattcttcttcataattgttgttacaactttttttcttccctgaagagatggcatctcgttcagtcatccaggttagaatacagtggcgcaatcgaagctcactgcagcctcaagatcccccaacctcagccgtctgagaagcatgcgttgtcacacctggctgttgtttttgttttttgttttgagacaaagtcctgctctatgaagcctcgctctgccacccaggctagagtgcagtggggcgtgatctcagctcactgcaacctccacctcctgggttcaagcaattctcctgcctcagccttgcaagtagctgagattacaggcacataccactgcacccggcattttttttttttttaaagacagggtcttactatgttgcccaggctggtcttgaactcctaggctcaagcatcttcccaccttggcctcccaaagtgctgggattacaggcacaagccactgcaaccggcataggacagattttccagctggaagccacttgttcacagttggtaaattatttctgagtcccaagggctgggagtagctgcctgaaatgctgcgctgggaagtgttctgtggctccatctggcactgttgcaagtgtgtaagtaagtcctacgtatgtgaatatctcatgccaatcctgatctagtcaaatcctaaacatatcataaagctagtaaatgttaaaagctgagtcacctaattctcactttagtaccataacccaaaagtcacaaatctgatttgatccttccagagaaaagacacatacgtgcccactttcagaagcattttcaaaaagtataacacttccaaagacaatacagcaggtccgtttccccaaaagaaactacagatagcctcaagcaacgcgacatatgttttatgtttcagcctaagaaacgttatctcttttttttttttttagatggagtcttcctctgtagcccaggttggagtgcaatggcgtatctctcagctcactgcaacctccgcctcctgggtttaagcaattctccggcctcagcctcctgagtagctgggactacaggagcccgccaccacgcccagccaattttttgtatacttagtagggacggggtttccccgtgttagccaggatggtctcgatctcctgaccgcgtgatccacccgccatggcgtcccaaagtgctgggattataggcatgagccaccgcgcccggcacagccttagaaacattcttaaaggaaccgcagctaaaactgacatcagactttgtttacaacctcctaccagcaccaccaccaccaaatgtaaaactatcctgtaatactcctatcacactaatttgtcctcttctccatccctgttcaacaatctaccatggatcaaaatgattctctagacagagaataaaatttcctttaaaatcaacaaacataacaaatttgggctcctgtatttaaagtaaacattaacacacactcaacatcacaattaagtttactaaaatactctgaagcgtttgcaatgaaaacctcttaagaataaaaacaggccgggcacggtggcttgcgcctgtaatcccagcactttgggaggccgaggcgggtggatcacaaggttaggagatcgaggccaacctggctaacacagtgaaactccatctttactaaaaatacaaaaaactagccaggcgtggtggcaggcacctgtagtcccagctactcgggagactgaggtgggagaatggtgtaaacccaggagacggagcttgcagtgagccaagatcgcgccactgcactccagcccggtcaacagagcgagactccatctcaaaaaaaaaaaaagaaaagaaaagaaaagaaaagaataaaaacagcagggcgcagtggctaacgcctgtaatccctgcactttgggaggctgaggcgggcagaacacctgaggtcaggagttcaagaccagcctgaccaacatggagaaatcccgtctctactaaaaatacaaaaactaggtagtcgtgataacgggtgcctgcaaccccagctaccctgggaagctgaggcaggagaatcgcttgaacccgggaggcagagtttgcagtaagccgagattgagccaccgcactccagcctgggtgtcgcagcaagactccgtctcaaaaaaaaaaaaaagagacccaagggccaacattcaatttctctacagaatcccagagggaaatgggaaaccagttcccttttagataaaatatttcaacaaagagaaaaacttcataaatacctactgataccatctggatttaaatacacttaacttcagccccctaaaattgaattgaatgaagataaaataaactgcttgctctccactcctcctgtcctcaacctttgaaacagtgtaaaggaagagctaaactaagttcccaaaatggaactccgtactgtagcaccatttcctataaaggcagcaattacaatttcatagagggcaggcggtgaatctaaattctagcttgatataacgacaagccaaggaatgtctaaagagagtacaaacaaatcctgcaactgaaagaggtgcctgtttcactccgtgcttgcttaccgtcaccctgcatgtctgaagtccatagtgtcagattatcacgtaacaactgcatgataagtgtagagtccttatagctttcttcactcagcgtatccagttctgcaattgcatcatcaaaagctgcttttgccaacctaaaggtatttcaatagaagtgttataaaaattaagtccaaaatcagaattagaaatgacatgctagacagcaatcttttcttcagttattccagtttgtaatagtcacaatgataatgcaaagaaaaagcaaatacaataaaaattaacttaaaggtatgtggaacactacttcttactatgctttaagcctgctactgatatgctataatatacatatcgactaataaaatacatagaacaacttccatcctaaaccatcaccaaaaaatatacctccaagttctaggcaatagttcacttatttcaaaaagttttgtttgtttgtttttaagacggagtctggctctgtcgcccaggctggagtgcagtggcgtgatctcggctcactgcaagcttcgcctctcaggttcatgccattctcctgcctcagcctcccgaatggctgggactacaggcgcccgccaccacacccggctaattttttgtatttttagtagagatggggtttcaccgtgttagccaggatggtctcgatctcctgacctcgtgatccaccagcctcagcatcccaaagtgctgggattacaggcgtgagccaccgcgcccagcctagtttttttttttttttttttttttttttttttttaagggattcgttatgttgcccaggctggacttgaactcctgcgttcaagcaatcttccgaaccttagcctcttgagtggctgggacaaacggtacacactaccacccccaagattttttaaaaaaaaaaaaaaaaaaaaaaaaaaaaaaaattttttttttttttttttttttttgggggacggggtctcgctctatcacccaggctggagtgcagtggcgggatgtaggctaaatgcaagctccgcctcctgggttcacaccattatcctgcctcagcctcccgagtagccgggactacaggcgcccgccaccacacccggctgatttgtttttatatttttagcagaggcagggtttcaccgtgttagccaggatggtcttgatcttctgacctcgtgatgtgcccgcctcagcctcccaaagtgctggattacaaggttgagatatttaacaaagtattaatgcaaaaagaaaatcttggacaatacctcaaagtttaaaaaaatttaatttcacgttaatggaggcagggaagcaaagaaaataaaaggcaacacagacgccatggaaatgtgattatgtaagccatttacagttttaaaagaaaatccacacttactgagtactgtgtactatgtccaacaaacgatacgatataccaatagaaaaaaaagagacataatctaagtccacatcaacttaaaaatttagaaatggagggtagacaaatacataactattttacaaggaggaggctggctgtggtggctcatgcctgtaatcagcacactttgggtggctgatgcgtgcgcgcagatcacttgaggccaggagttcaagaccagccgggccaccatggcaaaacctattaaaaacacaaaaaattaggccgggtgcagtggctcaagcctgtaatcccagcactttgggaggcagaagcgggcggatcacgtggttaggagatcgagaccatcctggctaacacagtgaaaccccgtctctactaaaaatacaaaaaaattagccgggagcagtggcaggtgcctgtagtcccagctacttgggaggatgaggcaggagaatggtgtgaacccaggaggcggagcctgcagtgagccgagatcacgccactgcagtccagcctgggcaacagagcaagactccgtctaaaaacacacacacacacacacacacacacacacacacacacacacacaaaattagccgggcatggtggcgtatgcctgtaatcccagctactcaggaggctgaggcagaagaatcccttgaacctgggaggcggaggttgcagtgaggtgaaactgtgccaatgcactccagcctgggcaagagagcacaaaaacaaaagaagaagaagaatgaagtgctattccaaataaagtatttcagggacccagaaggaggagcaattaaagggaaagtcaaatttgaactaatctcaatggataaggagaaaacaaaacacacttcaggtttaagcagaagcatgagcaaaggcatgcgagtgactttaaactggagctacacgtgggacagctagactggagtctgacaaggaaaggtgcaaccaccagtattagctaaatagccacagcttcttcagttacgatccctatctggacaaactcaactagccatttagaatgtttttacattggctgggcgcagtggctcacgcctgtaatcccagcactctgggaggctgaggcaggtggatcacctgaggtcaggagttcgagaccagcctgaccaagatggtgaaaacctgtctctactaaaaatgcaaaaaaaaaaaaaaattcagtcaagcgcagtgaagcatgcctataatagtcaacattaaagttccaatgtatcagttaatcccctttcctcaaactttgaaaggctttcacttaaaaaccctactttgcttaagcagttgtcctcaaacaaaccaaaaaaaaacacatacaaaaaccaaaaggggccgggcgcggtggctcacgcctgtaatcccagcactttgggaggccgaggagggcagatcacgaggtcaggagatcgagaccatcctggctaacacagggaaaccccatctctattaaaaatacaaaaaataggccgggcgcggtggctcacacctgtaatcccagcactttgggaggccgaggcgggtggatcacgaggtcaggagatcgagaccatcctggctaacacggtgaaaccccatctctactaaaaataccaaaaattagccgggcgtggtggcgggcgcctgtagtcccagctactcgggaggctgaggcaggagaatggcgtgaacccgggaggcagagcttgcagtgagccgagatcgcgctactgcactccagcctgggggacatagcgagactccgtctcaaaaaaaaaaaaaaaaaaatacaaaaaattaaccgggcgtggtggcgggtgcctgtagtaccagctacttgggaggctgaggcgagagaatcgcctgaacccaggaggctgagctttcagtgagctgagatcacgccactgtactccagccacagcagcagagtgagactccgtcaaaataaaaaaaaaaagcaaaaaaaccattttgctactgcaatatttactgtaaaaatttaaaataggctgggtgcagtggctcacgcctgtaatctcggcactttgggaggccgaggtggctggatcacttaaggtgaggtgtccaagaccagcctggccaacactgtgaaaacccatctctacataaaaatacaaaaattagctgggtatggtggcgggcgtctgtaatcccagctacctgggaggctgaagcaggagaatcgcttgaaaccgggaggcagaggttgcagtgagctgagattgcaccactgcactccagcctgggaaacacagcgagactctcctctcgggggaaaaaaaaaaagaaaaagacaatagcaaaaaacaacaacaacaacaaaatgccaacctacagaagaggagaaaatactcacaaaccatttacttgctaagaggttactatctggaataatgaactctcaacacttaacaaacgaaaaaaacatgaattcaaaaatgggcaaaagggcctggtgcagtggctcaggcctgtattctcagcattttgggaggctaaggcaagaggattacttgaggccaggatttcaagaccagcttcggcaacacagccagaccctgcctctacaaaacaaaacaacaaaaaaaaattttttttttgagacggagtctcgctctgtcgcccaggctggagtgcagtggcgtgatcttggctcactgcaagttccgcctcccaggttcacgccattctcctgcctcagcctcccgagtagctgggactacaggcgcccgccaccacgcccggctgattttttgtatttttagtagagacggggtttcaccacgttagccacgatggtctcgatctcctgacctcgtgatctgccctcctcggcctcccaaagtgctgggattacaggcgtgagccactgcacgcagcccaaaaaaaatttaaaaattggccgggcgcagtggctcatgcctgtaatcccagcactttgggagggaggctgaggtcaggagtttgagaccagcctaaccaagatagtgaaacctcgtctctactaaaaatgcccccaaaaattagccaagcatggtggcacatgcctgtaatcccagctacttgagaggctgaagcaccagaatcgcttgaatctgggaggtggaggttgcagtgagctgcgatcgcaccactgtactccagcctggccagcagagcgagactccatcttaaaaaaaaaaaaaaaaaagggctggccaagcacagtggctcacacctgtaatcccagaactttgggaggccgaggcgggcagatcacacgaggtcaggagttcgagactagcctggccaacactgtgaaaccccatccctactaaaaatacaaaaaattagccaggcatggtggcaggcgcctataatcccagctactttggatgctgaggcaggagaatcgcttgaacctggaaggcagaggttgcagtgggccaagatcacgccactgcactccagcctgggtgacagtgccaggctctccctcaaaaaaaagaaaaaagaaaaaaaaaaggaaaagaaaaggccaggtatggtggcatccacctctagtgacagctacttggaaggctcaggtaggcgaatcggctgagcccaggaagccaaggctgcagtgagctatgagtgcacaactgcagagacagaacaagatcctgtccggaaaaaaaagttacccacagaattttcagtcccaattccacctcaaggtgaagttaaatacaaggactcaagcaaatacttagtgcacccattttcatagcagcattgtactcaccatagggaaaaggtggaaacccactgaccaccaaaagtttaatgactaaacaatgtgtgcaaaatacataaaatgaattgtgtaaattcagtcactaaaaggactgaagctctgatccatgcttttacatggataaaaacattacgctagatgaaataaagacagccacaaaaggacaaatattatatgatcccacttacatgaggtatctagaatgggccaaattcatagtgacaacgtaaaataaaagttactagcagctagggagaggggaaatgaagttattgattgtttaatggctataattcgctttgtgtggggtgaagagaaagttttcaaatagtggtgattacacaacactgtcaatgtattcggtgccactaaattgttgtgtgtgtgtgtgtgtgtgtgtgtgtgtgtgtgtgtgtgtgtaaaagtctcgctttgtcgcccaggcgagagggagagggagacggggagagagagggagacggggagggggagggggggaggagggggagggggggagagagggggagagagagagagagagatttgaaaaaaagtctcactgtgtcacccaggctacagtgtactggtgcaatcgaggctcaccgcaacctctgcctcctgggttcaaacaattctcctgtctcagcctcccgagtaactgggattgcaggcatgcaccaccacacccggctaattttgtatttttaatagagacagagtttcaccatgttggtcaggttggtatcgaactcctgatctcaggtgacccacccacctcagcctcccaaagtgctgggattacaggcgtgagccactgcacccaggctatcacaactttttaaaagtaaaaagttatgtacgtataaatattccttacatatttatctacattatcaaaaactgggaacaagctgaagtataaatgggggaacagtttaacacacattagtaagactgaaacttgtttatgctaaaacagaaaatataaaattatgtttgctacgagagtaactattaaaaacatgcccatagaaacagaacactggctgggtgtggtgactcatgcttgtaatctcagcactttgggaggcgaaggcgggcggatcacttgaggtcaggagttccagaccagcctagccaaaatggtgaaaacaccgtctctactaaaaatacaaaaaaaattagttgggcatggtggcaggcccctgtaactccagttactcaggaggctgagacaggagaatcacttgaacccaggaggtgaaggctgcagtgatctgagatggcgccactgcactctagcctgggagacagagtgagacatggtctcaaatttaaaaaaagactgaaaactaatataacaaaaattaaaataattctaattcctctcatttccttcctctactcattttaacatgttagatttcaatctaccagcaacaaaaatatcccacatcaaaataattatgctgactgctatgctagtgggttgagacaggtctgttttaatactatccaaagtagtttcagtaagagccaaaagaattactatgcagccaagtctacaaagacaggcccaagaaacaacacggaaaacccaaacagcgccccccttaactttcacgctgagcgctgctgttcttccccacaacttacctgcaggcacggtcaggggaattaagaatttcgtagtagaatacggaaaaattgagagcaagacctaagcgaataggatgcgttggtggaagttctgtcattgcaatatcactagcagctttataagccactaggctgttctccgcagcctccttcctgtcgtttcctgtggcaaattctgccagatacctgtggtagtcccctttcctaaaacaaaaccaaaattaaaaaaaaaaaaaaaatttaaactaggaacgatttttaaaggaaaataagctaaaattgttctatattatataaaatgtgacaaaaatatatgtaacaattaggtgtacttcaataattttaaacactctcaggaataactggcttcgtttcatttttttccttagacatttcatattactaaatataagcaaaaatcccaggaaattaactgaggagcctctaaaaattaataaaattatcacctgatagaccagaattaaacaagcaagtggttccaaggaatggcatgacagtttattaatcataaaataaaatgtctatatataacactaagcactgtgaaatgtatgccgtttgggggaggggaatgggataggtctcacaaaaacaaaagaatataaataagcaaaagctaatacattttcataatagcccaaccaccttttcattacaatattaactatccttctaacattgaacaattattcttaaataaaagttgaaaacctacatagaacaaagttatggttctaaaaggaccaactttcaatcttacattttcccttctagtatagaacctacattttataatagaaaaccttggactcgccagtgttagctgctggaatgaggtgtttgtccagtacatccagaatgtcacaacagattaactttagctcagtctcaacctaaaaaaaaaaaaattttttttaaatcagattaagtctagaaattctacaaattattacatattctatctctggttttgaggtagagagcttagtattaaaaagaatttgtatccctctccaaactcccttcttccttcttgacacaaaagcagagaaaagctgcctctaggttataaaaagtatcttttcccttctgcatgctgcctattgttacacacacacatgcaggcacgcacacacgccagcccccacacccccttcacagtaccacagtacagctacagaattaccaatgactaaaactgaacactgatgcttcttggtaaatgctggtcaattacatgaattaccttctttcacaaggtagcaacgtaaagacattgctctaagatcaacaattaaataagaatttaataagcagagctaggatttgaacccaggcaggctgcaagggacagaatcaaaatttaaacccaggcagtttgccttcagcactcacatccttaacaacattcaccaggcaattcctttagtggcagagatccgtaactattaaaacaccgaaaacctatctaccaaagtagctactgccacccatctctatccactgatcatgctgaacacgcacaccacctctcaacgcacatcctcagcttgcttcctgtttgctattaactcatgcagcactactgctgaacctttcatgagggtcctctccgtgcccctggaacctccgtttcactgcagaaaattctctctttttcttctataatcacatccttatcccaagcaaaactactttctgaataaacgacatccctgacagcttttccaatagagactggtctaggagaaggaagacttctaagttctcctagctccttgcatactcaatgactgctctattactccaaactcttcctcctcacaagctgatgatctacattctatttctcagtttttgtcatcaatagatctctacacccttctcccagattcactgagtatctacagcaaacccacccaatacctgagatcacaccaaggtatggtgcagccatgttccattcaacagagttctttgctctctactcctagactttcacttgtccacacccatgaccatgctgctccatactagaagtctgaattgcaacactccactcttggcccgtggcttcctttttcagttcctcttctcttattatttctatttagggactcatcaggacatctggactctttattttttactttttctttctttgattcagagtttccctcttgttgccaaggctggatggagtgcagtggctcgacgttggctcattgcaacctccacctcctgggttcaagcgattctcctgtctcagcctcccgagtagctgggattacaggtgcccgccaccatgcctggctaatttttgtatttttagtggagacggggtttcaccatgtcggtcaggctgctctcgaactcctcacctcaggtacctgcccgccttggcctcccaaagtgctgggattacaggcatgagccaccacggaaggccccagctcacaactttctatgtgacctcaggtatgtcaaacacccaaaaccctggtttgtgcattcatagttgggataatacctcccccttccagtgccattttaaagatttcatgtactaccttgcacaaatacatgtaacaaaaatatttctctactcaggacagtgcccagtacagctggcgagtcagtaactgtggttcccccacccttccctcccccaaccaacctcactttccacctgccctgtaattctcttccctgttctttcctgtatttacgtgcctgtctcttctactagaatcggttactcaacagcagcactcccgacagtttgttgtggggcccgtgctgtgcccagtagaatggttagcagcaccccagtccccaccccactagatgctaggaacaccctccagaagttgtgacaatcaaaagtatttctagacattgttaaacgttctctgaagtacaaaagcacctctaattgaaaactgctgcattacagtgatggctgtccaacttttttttaacaagacctacaataagaaacattttatatatgtatatacacccacagtaagtaaaataacttcattaaataatcctcagggaaaaaaaaagaggaatcagacaaattaacccaatatattggtttttgggtgcttttttttttttttagatggagtctcgcgctctgtcacccaggctggagtgcagcagtgcgatctcggctcaccgcaagctccgcctcccggattcacaccattctcctgcctcagcctcccgagtagctgggaccacaggctcccgccaccacgcccagctaatgttttgtatttttagtagagacggggtttcaccatgttagccaggatggtctcgatctcctgacctcgtgatccgcccacctcagcctcccaaagtgctgggattacaggcctgagccaccgcgcctggccaacccaccatatttttttaaaaaacagtcatcattttgcttgaaaatacaatagttcccccttatccaagagggatccattgagacctgccagtggatgtgatgaaaccatggaaaataccaaacctgatacagactatgttttgtcctcatgcatagccacgggtaagtttaacttataaaccaggcacaaagatcaatatcagaaacattataacatactgtaatacaagttatatgaatgtagtctccttttctctcaaaatcttaagtgtaccgtcctacaggtaactcaaactgtggataaggggggatgatggcacaacaatctcaccatttgccgatattcccgaatcatttttagcttgtcttctcctcccttgttttcttctttctgttcaatgctgctgattattctccaggaggctcttctagctccaatcacattcttatatgcaacagataggaggtttctttcttcaactgtcagctccacatccatccctgctactttcttcattgactccaccatttctgtatgggaaaaggaaaagtcagaccttacaaatttgaagttttcttaacatattcctttcaaagtagtttttttctgtcaagctactgcgaaaaaaacattttaacaaaaataatttcataatcatcaaaactaatatgagtaaaaagccaaaaacatgtaaaggaaaccaaactaagagccaatacaaagactccagaaggtagttaggtggagtgagaaagacttcatatactatctaatataatttagtgtggtctgaaagcacctctcattaaataaggtaattaggcacacctaactattttccagcaaaaaaaaatgagctgtcagtttaagagaaagattaagaatttacaggttctaaaatgtattgtctcacaaataaatagtatttccaaaaatacaaaaggaaggggaatttgttcatacagcaaaaatatacggagtatatggttggccaccaacagactttggatgttttctatccttcctcgtatgaagctccttcattggtaaaacttctgatgattcctacttgttaccactaggtggcgagcaaagaaaggggcccagaaaagccttggcatctaccgcaagcatagggaaacacaacggcgtgtgaatgcaaagcgccacaaacagcacaagaaatagtaactgaataaatacattaataaaaacttatttttgatgccatattaccatgtggctctccaacattacccacgtttcaatctttggtgatgagactcaagaatctgcattttagggccaggagtaagtggctcatacccctagcactttgagagctgaggcaggagaatcactcgagctcaggagttcgagaccctgtctctaaaaaataaaaacagaggctgggcacagtggctcatgcctgtaaatcccagcactttggcaggccgaggtggcacatcaccaggtcaagagataaagactatcctggccaacatggtgaaacactgtctctactaaaaatacaaaaattagctgggcgtggtgatgcacgcctgtagtcccaggtactctagagactgagacaggagaatcgcttgaacccagaaggtggagattgcagtgagccaagatcatgccgctgcactccagcccagcaacagagactccacctcaaaaaaaaaaaaatagaataaataaaataaaaataaaaataaaaataggctggatgtagtggctcatgcatataatcccagaactgtgggaggccaaggtgggcagatcatttgaggtcacgaattcaaggccagcctggccaacgtggtgaaacggtctctactaaaaatacaaaaattagctgcgtttggtggtgcgcgcctgtaattacagctacttgggaagctgaggcagcagaattgcttgaacccaggaggcagagattgcaactgagatcgccccactgtatgccacctggggcaacagagcagactccatctcaaaaaaaaccaaaagaaagaatctgcatttaaataagcatccttagctttcattaacaccctaagcataagcataccttaactaataggtatgaaagagatggtgacttcataaaacactactaaattggacgggcacggtggatcacacctgtaatctcagcactttgggaggccaaggtgggtggatcgcctgaggtcaggagttcgagaccagcctggccaacatggtgaaacccgtctctactaaaaatacaaaaattagctgggcatggtggtgcacgcttgtaatcccagctaccaggaaggctgaggcaggagaactgcttgaacctgggaggcagaggttgcagtgagctgagattgcaccactgcattccagcctgggtgacagagtgagactccgtttcaaaaaaaaacacaaaacaaaaaccaaaacactattaaattaaggggagtgtgcctaatgtatccaggaaaatatgtttcaaaaattaatcctttcgggaatataaaaaaaattaagccatattttgtaaagtctcttcgaaaaatattcggcaatgttttaataaacatgtaccatatgactcagcaatcccaattctatgcatcatccagaagaaaaataatctttacaaagacttttacacactcactcacagcaactctattcataatagccaaaaagtggaaacccctcaaatgtgcatccagaggggaaatgtataagcacactgatgttcacatatgtaagatgggataccactcaaaaataaagaattaactgtccatgcacagtggctcacatctgtaatcccagcatttggggaggccaagacaggaggattacttgagcccagtagtttgagaccaacctgggcaacatggtgagactctgcctctacaaaaattagctgggtgtggtggtgtgtgcctgcggtctcaactactcaggagattaaggcaagagaactgcttgaccccaggaattcaggcctgcagtgagctattaggttggtacaaaagtaattgcgcattttgccagcaaaaaccacaattactttgtataatcctaacgctgtactccagcttggatgacaaagcgagagactctgtgtccagaaagagaagaggagacgggaggggagaaaaataattaactgatacaagcaacaatatggaagaatctgaaaaacatcatattaagtgaaaagagtcagattaaaaggattttatcattccatttatatcaaattgcaaaaaacacaaactaaaaagacagaaagcaaatggttatcaaggtacagaggtgaactgaggggcttttgtgcaaaggacaggtcacagaattgtacatgtaaaagtggcacgtttaactgtacacctcaagctgattttttaaatgcaattctgaaccattaaagaaggatgacatgttgggtgctgtggctcacacctgtcatcttagcactttgggaggctgaggcaggtggatcacctgaggtcaggagttcaagaccagcctggccaacatggtgacaccccgtctctactaaaaatataaaaattaggccaggcacggtgactcacgcctgtaatcccaacactttgggaggccgaggcaggcagatcacctgaggtcgggagatcgagaccagcctgaccagcatggagaaactaaaaatacaaaaaaatttgccagacgtggtggcacatgcctgtaatcccagctactcgaggctgaggcgagagaattgcttgaactcgggaggcggaggttgcactgagtggagatcgcgccactgtactccagtctgggcaacaagagcgaaactccatctcaaaaaaaggaaaaaaaaagaaaaagaaaaatacaaaaattagccaggcatggtggcaggcatctatagtgccagctactcgggaggctgaggcaggggaatcgcttgaaccccggagacaggggttgcactgagctgagatcgcgccattgcactccagcctaggcgacagagtgagactctgtctcaaaaaaaaaaaaaaaaaagtattacaatatggtaataagaccactcattaattcatttgtaggagtctgaaagcattcatctaaaacatgcccaattttgttttctaaaccagtcacgaaacagtctaaatttagaagcagtggaataggtaatcgtacctccatactagtttaattctcaaaaatcagcaagtcaaacataactcagaggtaagcctgtaattaaactttctaaactgatcgcaaagtaaatcttaagtaacccagctacacaaaaacagtgccattaattcttttaaggctttacaatattacatacagaaaaactatgcagacatcaaatactaccaaaaatttaagttacatatctcgaatatcattccttatgatttaattttgttcaaatttctgtgctttacaaattttcaacaacgaagacttagtatttttataatgcaaagagaaatatatttgtaacactcagtgatactctactgttccagattcaagcataaatgctttcatttttacatatacacaaaacaatgcacagactgtgtggtaaaattatagaagcaacaattatccctttaataatacctttatttatatataattcccctacctaacaattcacccatttaaagtgtactattcggccgggagcaggggctcacccctgtaaaccttgggaggccgaggtgggtggatcatgaggtcaggagatcaagaacagcctggccaacatagtaaaaccccgtctctactaaaaatacaaaaattagctgggcatggtggcaggcgcctgtagtcccagctaaccaggaggctgaagcaagagatttgcttgaacccgggaggcggaggttgcagtgacccgagatggctccactgcactacagcctgggtaacagagagagactccgtctccaaaaaataaataaactgtaccattcaatggtttttagtatattcacagaattctgcaatcatcataattttagattttcatcacttcaaaaagaaaagccccaaacccattaaccatcaattcccatgtacccgaaccccagcccggtcaaccaccaatctattttccgcctctacacacttgtctcttatgcacatttcaggtgcgggcataccttggaagatactgcgggttcagttccagagcactgcaaaaaaaaatattgcaataaagcaagtcacatgaatttttgtgtttcccagtgcatagaaaagttatgtttaaactacactgtaatctattaagtgtacaacagcattatgtctaaactgtacataatttaaaaacaccttattgctaataaatgctaatgctcatctgagccttcagcaagtgataatattttgctgttggaaggtttttgccttgatgttgatggctactgactgcttagggtgatggctgctgaaggctggagtggccgtggcaagacaatgaagtctgccatgttgatgggcttttcctttcctgcatgatttctctgtagcatctgacgctgttggacagcatttacccacagaaaaacttttttttttttttttttttttttttgagacggagtctcgctctgtcaccaggctggagtgcctgggcgtgatctcggctcactgcaagctccgcctcccaggttcacgccattctcctgcctcagcctcccgagtagctgggaccacaggcgcccgtcaccatgcccagtgaatttttttgtgtgtatttttagtagaggcggggtttcaccatgttagccaggacggtctcgatctcctgaccttgtgatccgcccgccttggcctcccaaagtgctgggattacaggcgtgagccaccgcgactggccagaacaactttttgttttttgtttttgagacagtgtcttgctctgtagcccaggcagtggcacaatctcggctcactgcagcctctgcctccagggttcaagcaattctcctgcctcagcctcccaagtagctgagactacaagtgggcgccaccacgcccggctaacttttctatttttagtagagacggggtttcagcatgttggtgaggctggtcttaaactcctgacctcaggtgatctgcctacctgctgtgttaacaggcataaaaacaacattgcaggctgggagcggtggctcacgcctagtaatcccagcactttgggaggccgaggtgggcagatcacgaggtcaggagatggagaccatcctggctaacaaggtgaaaacctcgtctctactaaaagtgcaaaaaaaaatcagccgggcatggtggcgggcgcctgtagtcccagctactcaggaggctgaggcaggagaatggtgtgaacccgggaggcggagctgcagtgagctgagatagtgccactgcactccagcctgggcgacacagcgagactccttctcaaaaaataaaaaatcaaaaaacattgctctccttacacaactacatcagagctccagggtgaccaagtactgtgtgtgagtgtgtggtagtgtgtgtgtgttttgaaacagagtcacactctgtcacccaagatgatacagtggcaccatctcagttcactacagcctcaacctccccagctcaagcgatcctccaacctcagcctcctgagtagctgggactacaggtgtacgccattacgcccagctaatttttattatttttttgtaaagacagggttttgccatgttcctcaggctggtcttgaactcttgtgctcatgtgacccacccatctcggcctcccaaagtgctgaaattacaaatgtgcaccactgcacccaacctcggtgcattttcaatgtgcagtaatacattgaagggaattttttttttttctgagtaccaagcttcaacagtgggcttaagatattcagaaaaccatgctgtaaacataagtgctgtcttacaggctttgctgttccatttataaaccaggcagagtaaatttagcatgattcttaaagaggcctcaaatttttcaaacagtcaatgagcactggtttcaatttaaattcaccagctgcattagtccctaagaagctgcatcagcctgtcctatggagctagacacactgacttctctctagttaagtgaagtcctagacagcattttcttctaacacaaggctgttttgtctacgctgaaaatctaagtggtgtggtcaccatcaataatgttagctaaatctggataatttgctgcagcatctacatcagcacatgctacttgaccctgtactttttttttttttttttgagacagaatttcactttgtcgctcaggctggagtgctgtcacaacgtctcagctcactgcaacctccgtctcctgggctgaagcgattctcctgcctcaacttcccgagtagctgggattacaggcgtctgccaccacgcccagctaattttttgtatttttagtacaggcagggtttcaccatgttggccaggctggtctcaaactcctgacctcgtgatccgtccgcctcggccccccaaagcgctgggattacaggcgtgagccaccgcgctcagccgaccttgtactttttaagtaatggagatggcatctttccttaaaccttactaaccaacctctgctaggttccagctttctatctgtagctttctcacctctctcagctttcttaaatttgaagagagttagagggttggtctgaattaggctttggcttaagggaatagtatggcaggtttgatcttctattcagaccaccaaaactttctgtcagcaagaaggctgttttgctttctcatcattgctgtgttcactggactagcactttttaatctccttgaagaacttttcctttgcattcacaactgtggtgcaagaggcccagctttcagaccgtgtctcggcttttaaggtagccttcctgactcagcttcatcatttctacctttttatttaaagtgagagactgggactcttcctttctcttaaacacttagaagcaattgcagggttgttaatcggcctaatttaaatattgttatgtttcaggtaataggtaagcctaacgggagggagagagacagggagtcagaacacaaacaagagctcacgcctgtaatcccaatactttgggaggccgaaggcaggaagatcatgtgagcctaggagttcaagaccagcctgggcaacaggtgagaccctatctctacaaaaaatacaaaaactagccaggcatggtgatgtgtgcctgtcgtcccagcttctcaggaggccgaggcaggaggattgctggagcctgggaggtcaaggctgcagtgagcattcctgcctgggtgacagagtgagaccctgtctccaaaaattaatagtaaaagaacacaggccaggcatggtggctcacgcagtaatcccagcactttgggaggccaaggcgggcagatcacatgaggtcgggagttcgagaccacctgaccaacatggagaaaccctgtctctactaaaaatacaaaaaaattagccaggcatgggggcgcgtgcctgtaatcccagctactcgggacgctgaggcaggagaatcgcttgaactcaggaggcggaacttgcggtgagccaagatggcgcccttacactccaacctaagcaacaagagcgaaactcagtctcaaaaaacaagcaaaaaaaggaatacacacatctatcaattaatttccctcagttcacggatccccaaaacaattacaatagtaacgtcaaagattactgatcacagataaccaccattaacatgtaatgaaaagtttgaggccgggcgaggtggactcacgcctgtaatcccagcgctttgggaggccaagaagggtagatcacaaggtcaggagatggagaccatcctggctaacacggtgaaaccccgtctctactaaatatacaataaaaaattagccaggcatggtggcgggcgcctgtagtcccagctactcgggaggctgaggcaggagaattgcgtgaacccgggaggcggagcttgtagtgagtagagatcgtggcactgcactccagcctgggtgacagagtgagacttcatctcaaaaaaaaaaaagaaaagtttgaaatactgcacaaggtaccaaaatgtgaacagagacaagaagtgagcacctgctgttggaaaatggcaccaacagacttgctcaaagcgggttccagaaaccttccatttgttctgtaaaaatgtagtatctgtgaagcacaatcaaacagggtgtacctacgaacagagccatacagtatggagcctcccatgactggcttctttcccaacacaacctaccgtatggagtcggctgtgactggcttctttcccatagcatggtctcaagtttcatgcctagtgtagcatgcatcagtacttcacctactgtatggatatactatgctttaaaaatccattcattaggccaggtgcggtggctcacgcctacaatcccagcactctgggaggcaggtggattacctgaggtcaggagttcagaccagcctggccaaaacatggcaaaaccccgtctctactaaaaatacaaaaattaggctgccatgatgtctaggcgaatgtctgtaatcccagctactcgggaggctgaagcaggacaactgcttgaacacgggaggcggaggttgcagtgacccgagatcgtgccactgaactccagcctggcaacagagcgagacttggtctcaggaaaaaaaaaaaaaaatccattcgttagttaatgaacatttgggttgtttccatttttggactattataaacaatgctgctacgaacgttctttaagtttttgtatgaataaatgctttcagttcacttcagtatacacctagaaggaacttcaggatcacatggtaactagctttttgaggaaggacatcccaaacttttctacaggagcggcaccgtttttacactcccaccagcaacacaggattctaatctggccacgtcctcaggaacacttgttagttattctttaaactagtcatcctagtgggtgtgaagctgtatctctttgtggttttgatttgcatttccttgataactaatagtgttgaacaccttttcatgtgcttatgagccttttgcgtatgttctctggagaaatatctattcaaacactttgccaaatatttaattatttgtcttttcattattggtatgtaggagttgttcatttttaaaaccccactgactcctcttaattcccccaaccccctctgcatcccttaaggtagcagattaaggaacagaagtagcattgagtcaggagacacttctattgcttcaagagacagggtctcactacgttgccctgactgtatgtcgtgcagtggctattcacaggcccatgatcacagcgcactatgtagccttaaactcctggcctcgagtgatcctcccacctcagcctcccaagtaactgggactataggtgcacactaccaagcacatcactccttcaagagtatggaaagtcaacttctcaatctctccaaacattctacgaccagtgctttgtaccagtttgtacaaataacgactacaatgacactctcttccaatatcactgtcatctttatccttttaacaccagcaacagaaacataatactaatgataatgtaccccaaaactatataagaaaagctgatttatccaaaactctagactaactacacccttcagccctccctcagtagaggatgaactccaaccattatattcacataaaggccctcaacacaactagcatttcctgaaatcacctttgcggcaagtattttatcagtgggatgtgggcatttcacgggtgggggaaggctgtcatgtgtttgcagcaggtgggatcgcaatttaagaaccaaaaaactgaaatggttgaaatcacttcttttggatccacgggcagttttgctacagtaattttgagtaacaaaatcgaatttctgggacttttcatggtttggggacaagggtgggtgattaaaatcgccactctgaaaaacatactcctcacaagttaattaaacatagttaagtctctttagttccaagtaagtttcccttcattgtatggtaatagcctagacacagatccaccacatggaaccagcttgtgtctgggacacccatcatctgctgctgccagtagagtcacaagtttttccccttgacttgttaactgaggtttggtttgtggttgtgttctttcaactatgttgttcattcaacagactaattcataaataaaacaccccatttcaactatgttgttcattcaacagacttattcacaaataaaaccccccatgctaaaataggcactgttccaaatgcttcgctgtattaatgtgcttaatcttctcaacagacctctgaagtgggtaccagtattatcccattttagaatatctccatatactgaagaacacgaaggttaaacttgttccagatcacaaagccagtggactacaactcagggaatctgacttgagttgtgctttgatttaatcatattgcctcagatttgaatatttatttgaatgcatctgtacgaggatccttttgtttgcttctgtgacaatagaggggaaataactggtttcagtgactctaccagagaaacaagtttcacatactaaaatgtggttgagacccaggcatggtggcgtctgccaccatgagagaaagaacgaagacagaaagacagacagaaagacaagaaagacagacagacagacagaaagaaagaaaaagaaagagagagaaagaaagaaaagaaaagaaggaaagaagttcactcctgcttaaaacgcatttctttttccacctagaggttcacccctctcccaaaaaaagcttactttattcttttctcttaaagagacgggagtctttgtatgttgcccaggctggtctccaactcctgggctcaagcaatcctcccacctcagcctcctgaatacaaaaagcttagtttcatacctctaatatctttacatcaacatcccagtaaacctgattttcccaagactgtccttgccaggtagtaaaacaagtctctgctgagcttcaacagtttctgataaacacaaagtacaaaatcataaaaggagcaggtctccaactatcaggctgacaagtcacaaggcacaatttacagctcctaatgaaattcagggtcaggaaaaaagcaaactgttcagaatctgccatgggaaaaacgagcaggttctgtactggctgacaggattaatgttcctcttaccaaagcacacagggtcataaccctaacttttttttttttttttgagacagagtctagctctgttgcccaggctgaagtgcaatctcactgcaacctccatctcccatgttcaagtgatgctcttgccccagcctccctggtagttaggactacaggtgcccgccaacgtgcacggctaatttttatatttttagtaaagacagggtttcaccatgttggccagactggtttcgaactcctgacctcaggtgatccacctgcctcggcctccctaggtggtgggattacaggcaggggttaccacacccggccctaatcctgattttaagggcagaaaaatgaagctaagagtaatgttcctaaagtcacacaatggtaaaacccaaactcaaacccagacaatctaacttaagagtctgagcttttagccatcacacttcaatgactttgcaaccagagtgctcacagaaacaaattccttagcccaagaacagtaaaagcaatcacaccaagggaagaaaagggcacagcatcaggcactgacataaaaaggttctgtcagaaccggaaatgtggctcacacctgtagtcagtcccagctactccagaagctgagacaggaagatcgcttgagcccaggagtccgaggccacagtgagctatgatcatgccactgcactccaccctgggcaacagagcaagactctgtctctcaaaaagaaagagttcagtcacttaggttctggaaaggtcctgagcttgctttatataaaggctaatcaattagccaatgacctttcctttttcctaggaaacatcatccctctggatcaaactcaaatgtcttactatgtaaagacttcctggctggaagcagtggctcatgcctgtaatcccagcactttgggaggccgaggcaggtggatcacctgaggtcaggagttcgagaccagcctggccaacatggtgaaaccccgtctctactaaaaatacaaaaattagctgggcatggtggcgggtgcctgtaatcccagctactcgggaggctgaggcaggagaattgcttgaacccgagaggcggaggttgcagtgagccaagatcgcgtcactgcactccagcctgggcaacagaggtgagactccgtctcaaaataaaagtctcaaattgtttttatggtttggaggggatagtatgcaagtttgttggagagaaacttacaaggtgctacttactaagaaatttaccttgcggatattttcttaaaaaggagtcatcacagaaaatgtatgcctagatttacatgtgagaagcagtcttcaattggatacttctgaccccatgaaataactgaggacatttctgcagaaggctgacatatgagaatgctcaggaattgtgtggctttcaaataatctgattcagcttggacaacctccaaggaatgaataaaattaggcaaaagcttgacaatcactaaacatagtcaattcacagataattcatgacaatcaacattctgccttactgatttctaaaaggtcccaatatcttgctagtcacatgacaactctcttgttactattcagaaatataaagatggagcaaaattttttctaaaacgattatcacgcaccttctctatcacactgacaaataatctgggaagcatcagttctgtactaaaaagcatgtctaaaaagcctgactcagaccatttcaggagcaatactactcgtttactataaaagaaattcagtacaggccaggcacggcggctcacgcctgtaatcccagcactttgagaggccaaggcgggtggatcacctgaggttaggagttcaggaccggccttggccaacatggtgaaatcccgtctctactaaaaataccaaaaattagttgggcatggtggcacacacctgtgatcccagctactcgggaggctgaggcaggagaatcgcttgaacctgggaggcgaaggaagttgcaatgagcaaaggtcatgccattgcattccagcctggcgacaagagcaaaactctgtctcaaaaaaaaaaaaaaagaaattcagtatgatccccaagaaagttacaaaacattctcagatggctaacctgaattatactggtttttaaacattaaatctctgcccaaatttggcaattttaattttatcataattaattcagctgcttgaagcctgcttaaagtttgcgatgtcatcactttaaggttgactatactcatgtcagtgtacttccaaatcacctaagagccctatgggatgttaagacacacttcagattttacatggcctcacgcctgtaatcccaacactttgggaggatgaagcgggcaggctgcttgagctgaggagtctaagcccagtctggggagcacggcaaaactccatctctactaaaatataaaaaattagccgggcgtggtggcacacacctatagtcccagctactctggaggctgaggtgggtggatcaactgagcccaggaagtcaaggctgcaatgagctgtgatcacgccactgcactccagcctgggcaaagaaagcaagactctgcctcaaaagaagatttcatacatgcaaaacttctaattcgaatgacgaaaaaaactatcaactacactaattctaatagtaaataacatggaaagaatctaagaatgtaacaaaatgtcaaatctgtagcttgaggagtcttaaatcatattttcttagaaaaacaaaatgcaagaatagtgatcactagttctactcaattaagatgagcaaaaggctgggatgtaccctggagcgtgttacgatgagttatgaaggaaggagtacttgaggtaaacagttggacaagatttaggaaacactcctggaacttgttttaatttaagcaaagatttaaaattgtgtaaaatgaacaggattagttggttgacatgtaaattatactttgtgttcagtacggtgaaagaaccagaatgctgtaaacagaaaataatggaagtactcagaagcttttctgaagaggccctattctagtctactaactttgactattattgtagtacccacataccacgtgcacttttattagacaaaaatgacacacactttgggaaacagcacaggaaagtcccaccacagcacagcaaacaccacacttacagcaaagagtttcagactagaagactagacttttttttttttttttttttgagacggagcctcactctgtcgcccaggctggagtgcactggcacgatctcggctcactgcaacctccgcctcccgggttcaagagtctcctgcctcagcctccgaagtagctgggattacaggcgcacactaccatgcccagctaaattttgtatttttagtaaaggtgaggtttcacgatgttgaccaggatggtctcgaactcgtgacctcaggtgatctgcctgcctcagccttccaaagtgcgtgagccaccgcgcccagcccagactagattttcattcctgcttattcatatgctatttgacctcaagtatgccacataatctctaggagcttgttcctcatccataacatggaggatatccagccctgagttatgagagtttaaaatgagattgtagagtaaattgtctggcatataatatgaattcaattaaatgtttaatttcttttcttcgcctcacttccaagattaaataacaaaaaaacaaaaccggaatccagacgggtgggggtgttaatgtgcctgatgtaggaaagagctaaataaagaacacagcgtttagaatctaagtctaataaagccttttgcagaatacagctccattttttctaacccagactttccattcttacatctcatatatttaatcccatatctgtgcttttggtaacatatccaaagaacctcactctcccaacatccaaatcttatcccccaattaatgtctcacctactattcaagttttccccgacaactgcagcacacaatcccttgttccccttctctacaattcctgtattatacaagctagaaatcatcattctggtttctagccacagcttgcctgattagactgtaactcttccatagtaggtattataagtaacgattttattactcacaaggggaaagttgttccccatacatgctaaagaaatacatattgattaaatggtccaagaggctgggcgcagtggctcacgtctgtaatcccagaacttcgggaggctaacaatcacttgaggtcaggagttacagactggcctggccaacatggcgaaaccccacctccactaaaaatacaaaaattagtccgggtgtggtgggattacgcctgtaatcccagcacttttggaggctgaggcgggtgactcacctgaggtcaggagttcgagaccagcctgaccaacatggagaaaccccgactctactaaaaacacaaaaaattagccaggcgtggtggctgtaatcccagctactcaggaggctgaagcacgagcatcccttgaacccgggaggtggaggttgcagtgagctgagattgtgtcactgcactccagcatgggcaacaggacaagactcatctccaaataaatcaataaactcaaaaaaataagtaaataaaacacgaaaggctcaagaatgcatgtaaaggggggaggggaatttcaaactatcaactaatcaaaacgtaacataaatgcactgaggaaggccgagcgcaaaggctcaggcctgtaatcccagcactttgggaggccaacgcgggtggatcgcttcaactcaggagttcaagaccagcctaggagacatggcgaaaccctgtctctacaaaaaaatacaaaaattggccaggcctggtggtgcatgcctgcagtcccaggcataggactgaggtgggaggatcactggaacgtgagaggtcaaggctgcagtgagcccagactggcccactgtactccagcctgcacgagagagcgacactatgtcaaaaaaaaaaaaaaaaaaaaaaagacaggcagacagaaaaggaaaaaaaaacacagatatataggcactggagcaaagaaaaagttattaaaggagactcaaaccactgacaagttacttgcggcataagtagtagtttttttgtttgtttgttttgagatggagtctcgctctgtcacccaggctggagtgcagtggcgcaatctcggctcacggcaacctccgcctcccgggttcacgccattctcctgcctcagcctcccatgtaactgggacttcaggcgcccaccaccatgcccggcaaattttttgtatttttagtagagatggggtttcaccgtgttagccaggatggtctcgatctcctgacctcatgatctgcccgcctcggcctcccaaagtgctgggattacaggcttgagccaccgcgcccggccttttttttttttttgagatggagtctcactctgttgaccaggctacagtgcagcagcgcaatctcagctcactgcaagctctaccggcaagctccgcctcccgggttctggccattctcctgcttcagcctcccaagtagctgggactacaggcgcccaccaccaggccaggctaattttttttttgtatctttagtagagacggggtttcactatgttagccaggatgatctcaatctcctgaccctgtgatccacccgcctcggcctcccaaagtgctaggattacaggcgtgagccaccacgcctggccagtagttttcattatttacttgatatggctgtactgctgactttacatttaaattcatcttttgcagtaagaaatgaaaaacaggccaggtgcggtggctcatacctgtattcccagcaatttgagaggctgaggccagcggatcacttgaggtcaggagatcgagaccagcctggccaacctggcgaaaccccatctctactaataatacaaaaattatccaggtgtgttggcatatgactgtaattccagctacttgggaggctggggaaggagaattgcttgaacctgggaggctgaggttgcagtgagctgacctcatgccactgcactccagcccaggtgacaaagcaagattccgtctcaagaaagaaaaaaaaaaaaaaggcaaaacaaaagtggaaaaactggctggtcgtggtggctcacgcctgtaatcccagcactttgggaggccgaggcacatggatcacctgaggtcgagagttcgagaccagcctgaccaacatagagaaaccccatctctactaaaaatacaaaattagacaggcatggtggcgcatgcctgtaatcccagctactctgggggctgaggcaggagaattgcttgatcctgggaggacgaggtttccgcgagctgagatcgcgcgattgcactccagcctgggcaacaagagcgaaactccgtttaaaaaaagaaatggaaaaactatttcacatactgtttaacttttttttttttttttgagacggagtcttggtctgttgccccggctggagtgcagtggcacaatttcagctcctggcaacctctacctcccgggttcaagcaattctcctgtctcagcccctaccagaagatgggattacaggcacgtgccaccacgcccggcaagtttttgtatttttagtagagatgggtttcgccatgttggccaggctggtcttgaactcctgacctcaggtgatccacccgcctcggcctcccaaagtactaggattacaggtgtgagccactgcacccggcccttgtttaaacaattttttaaaacacaagtttttagttaaattttgtgctgcacaatcgtaagttgctagtattataaacagttaataaaccttttcagaaaatagagtattcccgcaatctccgcactttgggaggctgaggtgggaagatttcctgagcccaagagttcaagaccggcctgggcaatatggcaagaccccatctcttcacacatttaaaaaattagccgaagagggctgggcacagtggctcacgcctgtaattcaagcactttgggaggccgaggcacgtggatcacaaggtcaagagttcaagaccaacctggccaacatggtgaaaccccatttctactaaaaatacaaaacaattagccacgcgttaagcaggtgcctgtaatcccagccactcgggaagatgaggcagagaactgcttgaacccaggaggcgaaagctgcagtgagccaagatccagccactgctctccagcatgggagaaagagcaagaccctgtctcaaaaaaataaaaataaaaaataaattagccaggcatggtgggcacacctgtagtcccagctacccaggacgcagaggtgggaggattgcttgagcccaggaggtgagggctgcagtgaggtgtgtctgctactgcacaccagcttgggcaagagtgagaccacatctcaaaacattaagagtacacatgtaaaaagatttatgctcgaccgggcgcggtggctcacgcctgtaatcccagcactttgggaggccaaggcgggcagatcacaacgtcaggagatcaagaccatcctggctaacacggtgaaaccctgtctctactaaaaatacaaaaaaaattagccaggcatggtggcaggcacctgtactcccagctactcaggaggctgaggcaggataatggagtgtattttgtattttgagggtttcaccaggctggtcttgaactcctgacattatgatccatccgcttcagcctcccaaagtgctgggattaaaggagtgagccactgcgcccagcccagagtttttctcttgttgctcaggctggagtgcaatggcgctatctcggctcactgcaacctccgcctcccgggttcaagagattctcctgcctccgcctcctgggagtagctgggattagaggcatgcgccacgaagcctggctaatttttttttgtatttttagtagagacgggtttctccatgttggtcaggctggtcctgaactcccaaccacagatgatctgcctgccttggcctcccaaagaaattttttttaaaatcagtttcaggtttgttttttctttttagaggagtctccctatgttgccctggctgccttgcagtggctattcacaggcatgaccataacactccttggctgaagctcaccctctactgcactccaccctgggtgacagggaaagactctgtctcaaaaaaaaaaaaaaaaaaagtaaagataaaatgaatacagaaatgttggcagcattctgaaaccagaaaagttaaaggttaagaaaaaatctgcagcaataagataaaggcattaagaccatgttaatgatgtgcagttattcattgttgagaagatgaaaatctaccagcaactggtctagaggaaaacaccaaggtcccctgtgatcagtcccccaggcctcccaactacatgcctcaaaagtcatctactgaaaaggtacacaacgaaaaagtacaccatactgcaatttactaagttcccagagcttcttatccagccatttataaagctctagtcccaaatatcagtggtccccaacctttgtggcaccagggaccagtttcgtggaagacaatttttccacagaccagtatgggtgcatggcctgggcactggggacccctgcatgtatcaaagagttaaaaacaaagtaggtttttcagagggtgggggaggagggaaggaaggaagacggaggatgcaggtggcctgctcctgaatttaatggctcctatcccaatactagttccattacctgttacctgcaaaatatactcagcctacattccattctgtcttcttcatacattaaagacaacactattcagagagaagctgagccaaaagactgctataatcccagcactttaggaggccaaggcaggaggacttcttgagcccagctgaaagaccagcctgggcaacacagagacccccagtctccacaaaaaagggggaaaaaaagaaaagaaagcctcaagcagtctggactgacgtttacacacaagaaactccttccgaagtggaaggagtaccagctttgcagggcaccagccttggcagaataccagtgacatttcaaatgtgttgtcacttttcctcaagtactggatccttatctgtaaaatgggtagtactttgcatggctgtttggataacaagtgaaagaaatagccaataaacagtagatgatattattattacagggtttcatcacaatgaaacactttaaagaggtttttcaatttgttagtaccattttacaccagtagtcagtgaagaaacactgagctttctacagtctttaacatgggacacccagcaactgatacagtaccctgcatataccagacaccattggtgctaattaatttaaactaactcttaattacacataggaacagagtaactccgaaagcaatcatacattcactagaatataaagtccttgaaaagatcttttgtctattttgttcactgatgaatcccaagtgtctaaagtgtctagaacagtgcctggtacatagtcggcattcagtaagtatttgtcaaatgagtttgggaacttgttttttagtactttaatactttgattaaggcttttcaaaagacaataatcttgacactcaaggacaacttttactcttcatataccagcctatacagaggtacctctcctcactctaaaagtaactacatgagccaggcacggtggctcacgcctataatcccagctctctgggaggccaaggcaggcggatcacctgaggccagaagtttgagaccagcctggccaacacggtgaaacacccgtctctactgaagaaaaaacaaaaattagccaggcatggtggcaggtgcctgtaatcccagctactcaggaggctgaggcaggagaatcacttgaaccaaggaggtggaggctgcagtgagccaagatcgcgccattgcactccagtctgggcaacagagtgagactccgtctcaaaaggaaaaaaaaaaaaaagaggaaaacatgaattgtgtaaccttctatgaaactttaagactcctttccaaatcagcttttgctaggttaaaaagaaacaaaaacaagacaatcttttaccaagattctacaattttgactgcaaaagctacttttccctttggtctcaatatttagggcagggttgtgctcactttggcagcacatgtactaaagttggaatgacacaaagattaaaaaacaaaaataaaaatattgggggtgggggagtaatcccctgctccatcagaatgggagatttctcctctcaatttacgaggatactccctcataaacacgttcggctgcagtagaaccaaacaggtgaagctccagtgaaacctgaggtggaaaataagaggctggggagatcaatgacctaaaacactaagtacaggaaaaacaggtagatcaaagtctgaatctttttacagtttttatggaattagaaaagacactgaaacaaaaaatactttaaaattctgttttggaatactaaggaagaaaatgaccacaaataacccttgggtccaattcggtttagtagaaggattaactttacattcagatttttaagaagtttgacatgttttctcaagtggttgagagtgttaagcatttctttgcgggggtgggggcagtaggcggggatggagtcttactgtttcccaggctggagtgcagtgccacaatctcggcattctgcagctttctacctcccgagttcaagcgattctgctgcctcagcctcccgaatagctgagattacaagcgcacgccaccacgcccgtctaattttttgtatatttagtagagacggggggtctcaccatgttcaccagcctgatcctgaactcctgacctcaggtgatccacccttcttggcctcccaaagtgctgggattacaggagtgagccactgcacctggctttttttttttttttttttttgacggagtctcactctgtcgttcaggctggagcccaggggcactatctcggctcactgcaacctttgcctcccgggttcaagtgattctcctgccttaacctcctgagtagctgggattacaggcacgtgccaccaccacgcctgggtaatttttgtttttttttttggttggttttttttttttttttttttttttagtagagacgaggtttcaccctgttggtcaggcttgtctcgaactcctgacctcgtgatctgccctcctcggcctcccaaagtgctaggattggccaggcgctgtggctcacgcctgtaatcccagcactttgggaggctgagttgggcggatcgtgagatcaggagatcaagaccatcctggctaacacggtgaaaccccgtctctactaaaaatacaaaaaatgagccgggcgtggtggcaggcgcctgtagtaccagctactccggaggctgaggcaggagaatggagtgaacccaggaggtggagcttgcagtgagccaagatgcaagtggagcgccactgcactccagcctgggcaacagagcaagactctgtctcaaaaaaaaaaaaagtgctaggattacaggcatgagcaaaccatgcccagcctttttttttttttttttaatagaaacggagtcttgcaatgttgcccaggctggtctcaaactcctggcctcaaatgacctcccaccttggcctccaaaagcaatgagattacaggtatgtcaattctttgatgagctaagaaacccccatcaaaatttcaacactttaatattttaatgtttcctaagtagtatattctgcattaagtatttcatactcatgaatgtgtttctaaaaatctacaaaaactgtcataactgtcatacaacagtgacaatattttctggtcaaataacgttcttgaaaatttcacggtaatcctatcataaatcttaactattttacaagtaaacctattacaatcaaatacaagtcattaatcccactaaatctttctcctttcctttttgagacagggtctcactatgtcacccaggtgggagtgcagtggtcttatcatggctcactgcagcctcgacctcccgggctcaagaaatcttaccaccttggcctcccaagtagctgagactacagacacatgccactaggtcaagctaattctgtttctttttgtagaaacagggtctcactatgttgcccaggctggtctcaaacttttgggcttaagggatcttcccgcctctgccttccaaagtattggaattacagggattattagccactgcacgtggcccctactaacatttaaacacttaaatttcaacataaaggtgttcacaacaaccactccaaggtcctacaaagtcttcagctgactaacccagggattaagtagtatttagtagctttttattaatcaaaacccattcactgtccaaggcttatattatgcctttagaatcacatttcacaaaattggtcatagctaacaccatttttcttaagtaatctgagatggctaaaatgcgaacatttaacaatgatttacgttttctttctttttttttttttttgagatggagtctcgctctgttgcccaggctggagtgcagtggcgcgatcctggctcactgcaagctccgcctcccgggttcatgccattctcctgcctcagcctcctgagcagctgggactacaggcgcccgctaccacgcccagctaattttttgtatttttagtagagacagggtttcactgtgttagccaggatggtctcaatctgctgacctcgtagtccgcccgcctcggcctcccaaagtcctgggattacagccgtgagccaccgtacctggccaattatttacattttctttctttctttttttgagacagagttttgctcttgtcgcccaggctggagtgcaatggtacaatctcggctcactgcaacctccgcctcccaggttcaagcaaacctcctgcctcagcctcccgaggagctgggattacaagcgcctgccaccacttcaagctaattttgtattttttagtatagatgggatttctccatgttggtcaggctggtcttgaactcccgacctcaggtgatccgcccaacttggcctcccaaagtgctgggattacaggtgtgagccactgcacccagcctacattttcatattacagcagctttcatcccaaattcagacaaaaggtgttacgtttgctaaggagaaagtctcttattaatctaaaattaatatcaaaacaactatataccagctcaacatgacaaaattattatttgggaataatctggacgacctttactttggatatgcaaatttacagatgtaagattaaggattttgagaatatttctttgtgcatatcttacataaggactaagcccagaagactacacttgctaagaataactcaaaaaggtaggttatcatctaatatgatcctagcacagcagtaacaaaaacaattatctgacctttcacattagataagaatgtttcacaacaaatagtaccgacaagtattacactttacagtttacaaaagcccaaaatttcataaccaccctgcaaattagtaggcaagagagacatcactaatccccatttgaaagataaggaacccagtgattcctgtgcattctgtgatggcagatttaccacatctgccaaatgatgaaatactgtcataactcttacagtaatgcatctccttcaaactttagatatgaatgaagagttaaacacatttcatattgctttagctcgataaaatcctgatctgatcacaaatcaagcccaccaacaacagatccgtccagctactatggtagattgttggaagggcaataaattcaagataaaaatttcagaagagataagccaggatcatggtcatatggtctgaactacacagtttggcattctaaacataacagttgtaacaagatatgggtgagcctttaaatttttatgtgggtatttggtatgaaagacacttgtaaaaataaaaaaataaaatgtatgtagggaaagctctgagcttaggacactgctaccaacacctaggtctattatatttttaaacacagaactggctcaaggtagccataagaaaaccaacacactaggtgttgacaccatcagaggatttggaatgccagcaagctctattttcagcaactaccacatccttaactagcacgttcccatttgtgggggagggagctaggaggaggaaattttcacttttcctttgacttatattctgccaaaggctaacttcatttgaaaaaaaaaaattcaacctcctagagacgtagatctaagctatctctgtgataaaaagctggacaacgtttaggaaactgttgtatgagtctaaatgacaaaatctagtaacaaatggccattaagtagggtgaccacaaggcaagtttgttgcccaggacaatcccagtttatgcctgctgttgtagctgatgaattagtctgtcttttcaagatatactcatgtggatgttaaattatggtgactttcattattatttgctacaatttaataaatttaaatgaacatctgaaattgttcttagggccatgactagcattaacatttagtcagagaaccatgaggttctgttggcaaccaattcgtcaatttggatatatcaatacctaaatatatcaagctggccgggcgcagtggttcatgcctataatccctgcactttggggaggccacagtgggaggatcgcttgaacccaggagttacctggacaacacagtgggatcccgtctccacaaaaaaaaagttttaattagctggtcatggcggtaccagctacctggtgggaagatcacatgagctcaggagttcaacatcagcctgggcaatccgctgggaccaggcctctaccaaaaaaatttttttgccagccatggtggctcacgcctgtaatcgcaaaactttgggaggccgaggcaggtgaatcttgagctcgagttcaagacctgggcaacatggtaaaatcctgtctctacaaaaattagccagaagtggtggtatacttctgtagccccagctacttggcatgctgaggtgcccagggggtcaaagctgcagtgagccataaatgtgacactgcatcccagcctgagtaatatactgagatcttgtctcgggaaaaaagaaaaagaaaaagaaaaaaaagttcttttaaattatccaggtattgtggtgcacagctgtgggcccagctaagtgggaggctgagatgggatgatcatttgggcctgggaggttgaggatgcagtgaatcgttactgcatcaatgcaatccaagcctggccaacaaagcaagaccttgtctcaaaaaagtatatgtatctatctcaaactgttaactgaccatttcaaaaatagtgaaaatagccatttttcttgctgctctttcctactccttaatggattccattagacagctatctagccaaccacccggaacaacactggtgaatcatatgccaacctttgtccctcctagaagttgtatgtctatatctggccgggtgcggtggctcacacctataatcccagcattttgggaggctgaggcaggcggactacctgaggtcaggagttgaagaccagcctggctaatatggtgaaactctgtctctactaaaaatacaaaaattagccaagcatgatggcccaagtctgtagtctcagctactcgggaggctgaggcaggagaatcacttgagcccaggaggcggaggctgcagtgagccaagatcacgccactgcactccagcctgaatgacaagagggaaaatccatctcaaaaaaaaaaaaaagttgtatgactacatcactaacctaacaacttaatagcattcactaagacaaaggtggccgggggtggtggctcacgcctataatcccagcactttgggaggccaagtctgacagattgcttgagtccaggaattccaagaccagcctgggcaacatggtgaaaccccatctctactaaaacacaaaagaaattagctgggagtggtggatcgcgccactgtactccagcactccagcctgggtgacagagcaagactccatctctccaaaaaataaataaataaataaataaataaataaataaataaaatttaaaaacatacaaacaaacaaaaaaaacagctacttaagaggctgaggtggggggatcacctgagactggaaggtagaggctgcagtgagccaagatcgcaccactgcactacagcctgggtgaccaagtgagaccctgtctcaaaaaaaaaaaaaggaaaaagataaaagtgagaggagaaaatattttaaagctactttacagaaatgcatagcatcagccatatcccagtacagacattatgataaactacggggcttttcttttcttgagacaggctctccctctgtggcccagactggagtgcaatggtgcgatgtgggctcactgcaatctccacctcccagggtcaagcgatttcccacctcagcctcctcagtagctgggactaaaggcacaagccatcacaggccagctaatttttgtatttttagtagagactggttttcaccatgttggtcaggatggtctcaaactcctgacctcaggtgatccgcccacctcggcctcccacagtgctgggattgcaggtgtttgagccgcggaacccggctggggcttttctttttttggttgtttttttcttttgcttaaagaggtgacatctgcctacaataaatcatgttttttaagaatctgtatgcgaataaacattctgagagtacctaaacttcacctcattttaatttcgctgtgccttgagatgggattttatctctgaaaaaaaccatcaggtttctttaggaaagtgaaaagattttgtctacaattcaccatggatatcagtcatcacaaacatcaagatgtgaagtagatgctattagaattgttaaagaacaagcatcaagcatacgctactcaccccctactcccctgaaaggcaccaccttacttcacagaggtcttttgagtggctgagagtaagtgtaccgatctaaaggtcagcagacactaagttctggctttaccatttaataactgattagccacatgatcataaaaaaatctctctctcaaactcactttcttgaaccagaaaatgggagtaacgctctacctgcttcaatcttgttacataaattaaaaacttttgtcaacgtgggctgtgaactgaggtactgcataatgtcatatacacatatgtaaagtttaggccagaagcagtgactcacacctgtaatcccagcactttgggaggccaaggtgggagtccaggaattcaagaccagcctgggcaacatagagacctcaaatccacaaaaaaaaaaaaaaaaaaaaaaaaacacaaaaattaggccggtgcaacagtcccagctactagggaagctgaggcaggagggtcactggaactcaggaggtcgagcctgcagtaagctataatggcgacactgcacttcagcctgggtcacaaagcaagaccctgtttcaaaaaaaaatttttttttaatttagccttcccataaatacatacacctaatatgtgcccattaaaaaattaaaaatttaggccaggtacagtggctcatacctgtaatgctagccctttgggaggctgaggcgggaggatcacctgaggtcaggagtcagagatcagcctggcaaacatggtgaaaccccatctctactaaaaatacaaaaattagccaggtgcgatggcgggcgcctgtagtcccagctactcgggaagcagaggcaggagaatcgcttgaacccagggggcagaggctgcagtgagccgagatcctaccactacactccaccctaggtgacagagcaagactgtctcaaaaaaataaataaaaataaaactgcagcctttactccatgcttgtcattactgtttgtgtacacagtgttcttgaaatataaagaaaaaatatgcctgcagtatcagtcacccttacagtcatccatgaaaaaaaaaaacaatcaggccgggtgtggtggctcacgcctgtaattccaacactttgggaggccgaggcaggcagatcacctgaggtcaggagttcaagaccagcctggcaaacatggtaaaaccctgtctctaccaaaaacacaaaaattggctgggtgcggtggctcacacctgtaatcccagcagtttgggaggctgaggtgggcagatcacctgagatcaggagataaagaccatcctggccaacatggtgaaacctcgtctctactaaaaatacaaaaaattagccgagtgtggtggcacgcgcctgtagtcccagctacttgggaggctgagccaggagaaccgcttgaacctgggaggcggaggttgcagtgagccaagaccacgccattgcactccagcctgggggacagagcccagtcgtagaagggatttttaacactacgttactcagttctgtctatgcatttaagaaggagaaaaataaactttactccagaaagttagtccattaactgaaacggcaatggaaaattactggcctacagtcaaagaactggtagttaatctaaatacttctaaacttattaacaacgttaatttactactacctatttttttcctaacaagaccgtagtaaaaagttcattccacacatgctcccttccctgttcttcactaactagcagaataagctagctagagatgaggatctggtgttttaaaaggacagctctcagcgggctcagtggctcacgcctgtaaccccagcactctgggaggccgaggcgggcggatcacctgaggtcaggagttcgagatcagcctggccaacatggcgaaaccccatctctactaaaaatacaaaattagcctggcatagtggcggatgcctgtaatcccagctactcttggaggctgaggcaggagaatcgcttgaacccaggggatggaggttgcagtgagccgagatcgcgctattgcactacagcctgggcgacaagagcaagactccgtctcaaaaaaaagacagctcttgaccaggcgcggtggctcaggtccttaatgtcagcactttgggagactgaggtgggcggatcacctgaggtcgggagttcgagaccagcctgaccaacatggagaaaccgtgtctctactaaaaaagaaatacaaaattagcatggcatggtggcacatgcctgtagtcccagctactcgggagggtgaggcaggagaatcgcttgaaccctggaggcggaggttgcagtgggccgagattgtgccacttcaataaagcctgggagacagagcgagactccgtctcaaaagaaaaaaaagacagctctcaagtaaatgactcaacagatgcattcctagggaatccaacatgaccatcaaaacttcatcctaccttccatgaagccaatcttgatagggaagagactaggaaaggacaaaaccaacaacagccccacaagcccaaatgtagtttatgttacccctctgctccccaaaaacgggtaaacttttcccctctatattccccgttttttattgttgctgttgcccaggatggagtgcaatggcgcaatctcggctcaccgcaacctcggcctcccgggttcaagtgattctcctgcctccgcctcccaagtagctgggattacaggcacccaccacccccggctaattttgtatttttactacagacggggtttctccatgttggtcaggctggtctcgaacttctgacttcaggtgatccacccgccttggcctcccaaagtactgggattacaggcatgagccaccgcacctggcctcttttttttttttttggagacaagagtctcgctctgttgcccaggctgtagtgtaatgccataatcctggttcactacaaccttcacctcccgggttcaagtgattcttccacctcaacctcctcagtagctatgcccggataatttttttatttttgtagagacagggtttcaccatgttggccaggctggtcttgaactcccgacctcaggtgatccacccgcctcgacctcccaaggtgctgggattacaggcgtgagccaccccgcccggcctttcttccccactttcttgtactatttcatatacgggacagtaagagctgtttgagaaatgctaagaaataatggacttgcttaatatggtttcaaaggaggtaaaaacgattcgaatagactactggcttgttaaagtgatgagatgctagatttaatcttcaactcccagccccaaacttaaatatttcctgtgacccaaaattgtcattttcctgaacacaggttagctcttcctcccgtactgttaaataatccatataaattgattccaacgccccaggatagaattaaatgaggatacaaagaagtttaggcactaattcaacacagcaagcaaaataaaataagcctgctgcagtaacagagagataaaagggcagctggaaacccagcatttgggtacaagtacccaacaaagaaatcctgccaatacactgtcttaccttcttccacccccgacacctgctaagttctgtttggtgaccagaactccgggaaaactttgccaccagaaacaaaaaaataccgcactcaataaaggaatggacacaggtagaggacacaggtagaaattcctggtttctgtctcctcctcctcctctcctttccactgagtccctaccttatgccccaagtcacagcaatagctcctcaccttgtagatcctatttccttacccctttagatcctgaaggggacacctaacattaacaactgtaataatgtggctgtatcagagtcccatgttcaataaccaataagggctctggtcagaaatcctcaccactcacatcaaaaatataattatcactaacctgtactttatttggaaactacaatcacaagctttcaaatcagttttttaaaggagctttcaaaaagaaaaagacctttcctcacatcctttctagttatcacagcaagtttacttaaaaagccccaatacccacaaaatagaaagcattcaagtacaatttgtttcctcccaagaacactaacagattaagaggggaacatctggagatgagggggcggaggaggagacttccaatacaagcacattcatatctctttgatttttaaacactgaaataaagacaaagcagaccttgagctgtacttccccatcttatccccccccccaacaggaaccttgttgaatacaaatagcaatttaagaatttacaagacgaaatttagttcactatatttcctaaatatgagttctagaggccttgtcttattttcaaatccctgaatcttatttctgatgataagggggactaaccctgaggttattcacatgactaaatccgcatttcgaggaaagcaagggccctaacattttgaaatataggtattttaattaggaaaaaaatctaagaatcaaagatacttgattccaaccatgtctcaccccaccctaccacgcaaaagcattaaaaccacaggacccacagacatgacctttcgtttaatactacagtatcgcacaattataaatgtgtgggtatttcaaaaggtggtccaaaaggtggactgggagagaggattaagaataaacttcctgacaatgactggacagacacaatggacattcgatgaagttctgaaaaaggactggagaacccattaggggcaaaagaacaacgaacaaagaggacctactaatatttctacataaacccatttatttaaaacggaaaaaaagaaagcaacaggatcttcaaccttcataactcaaaaaacccagcctcagccgagcgcctggaataggttaagatcccccacgaagtacagaccagcattccgagcctgcagagtcaaccaaaatacagttactgaacactattggaaataactttatttcaacaggtcttcccatttgtcatcacggtgcgcacaaactgtaaagtcatcgtttttacaaacggggggacggaggctcgggctctacaaaggctcgaactctcagagtcgtggcctcctggttctatccatcagaacccacgggtgatggagccagagaaaggttacaggaacttcgagatctcctgttttaagtctgaggaaagggagggagtgaggattttctgggcctccccagaagacgacgaggaggaaaagccccgaaacccctcactacgaggtgccggcctacgggaaagaaacccgatcgcagcatgggagcctgccaccgcccgaagacgaactgcagtgattcccactcacccctctccccccaccatcatccacgactgtcccccacctcaggcctgaggaagcccatcgctctcaaaggtcctcctttgtgagactccacggccgccgccccacacggggcctccggggaaaagccaccgcccccacccgccatatttccctgaaaggcgcccgcgctacagctcccggtcttcgctctctcccatgtggcgggtgctgcttcccccgtcaccccacccaattgttctccacatcccaaggccgtcccagaagctcccatgagggtggctcgttcggagacagcacccgccatctcctccccctcccccgccccgggactcgccctccccccagccgccattttacaaccaactcctccaccccgtcgccccggcctcccggcccgcgagttgtttgcagttaaggacggcgaaggggtcacattccagggcatagagcctcccatcgccccgggagctcccaggccatttcctgcttcccgaacccaagcccccgggccaggctcgcagacgatgccgccattttgtctcctgttcccggcctctgtgggcggcggcagagggtccgagaattccagccccccgttgcccccccaactcaccgtcgtatcgctcagcctgctcggccagcttcgcctggtacaccagatcctctcgatcatccatagcggcagcggctccggcagggtctgcgcgacggatggaagcggatagtgtctccgactctctcagcctctcgctccgcgtccgggcagcaaaaatggcggcgcctcaatccgggacttccgcctgcgcacgcggacaactgctcagctcta

SEQ ID NO: 186 - DNA, 55724 bp, Homo sapiens; identical to SEQ ID NO: 185

SEQ ID NO: 187 - DNA, 10270 bp, Homo sapiens
aggaaccggagcctgagagccgggcgccgtgcgctcctccccgcgctgtctcggcggcccagggtgagtcggccgcggccgcggggcggggactgggaggggcgcggtcctccgagcccggcctggtggaggctgtagcccccgcagtgggcgcgcggagctcggcagggagcggacccgcagccgtcactgtcgcctccgctcgccttgggttccgaacccttatcggggcgaagggccctgcgccccggtccatgctggctgtggtcgggggcgtgcggccgggcccccgagacccgctccgccgagccggacggttgcgcagagatgaggctgcaggcggggaggcctggcgaggtggggctgctccggggaggaccaggctctgcccctcgcttccgtccgatggcgggctcttcccggcagcctcgctccccggcggacgccgtttcccgcagcgttcatttaccctgcgcagttttgccccctccccgggttggggcatttattggaccaacagtcatttcgtaaatagctgttgggtatttaactgtgagcgttccggtgctggggaccccgcagtgagcgaacagcccgcctcgcctccaggagcatgaattgtaatagaggtgaggcgttagtgtaacaggcaataacgcagcaaaataacttctggttttgacaagggcctcgcacagaataaaccaaggaaataaaattgtgagagttagggggttagggtagccttggcggtcaggggaggctctgtaaggagttaacatttggccgtgcgcaatggctcacgcctgtaatcccagcactttgggaggccgaggcgggcggatcacgaggtcaggagatcgagaccatcctggctaacacggtgaaaccctgtctctactaaaaatacaaaaaattagccgggcgtggtggcgggcgcctgtagtcccagctactcgggaggctgaggcaggagaatggcgtgaacccgggaggcggagcttgcagtgagccgagatcgcgccactggtctccaggctgggcaacagagggagactctgtcgcaaacaacagcaacaacaaaaaagagttaacatttgaactgaaacctgctggaggagagaagcagccacagatccctgaggagaaactcccaggcgggggaacagagagaaggctggcatggctgcggcgtagtgagccgggtgccccaggtccccgaggaacagggcttattctgcgtatggaaggaggtgacccctcctagtcttccagaccccagttaaatgagttcccccagtaacatttcttggtggtccttcatctaaaattagcaccctcctccccttgacattttctgtctcagcaacagcttgatctgttgtcatcatatcactgctccattatttttagctcagtgctgtttaatctgattgaaggtttacttcctaattccgaagatagaactaaaagcaggtttttttcccctctaaccaggtagcccctccctgaggacatgcactccctagacatgagcaaacacaaagcagcagtaacttaccgctcctagtccaagtcctaccctagtcctgggttgcagttcttaccagagtggagggtggtatgtgttgaggggtcggggatcaagtcttctggcagcctcataccctgagatactctggttgccttgttggggtgaggacaacacgtgtggccatcgcagtggcccaggtgggtcctgccacagactgccctggacagacagtgagtgggggctgggtgggggtggtgtggccctgctcttccatgcgtttgcagtctgtgccctctgtgcaggggtgattcacgaatctgtctgatccacccccatcgcccttcgtaccctaacatgtcaaaagggctctgctgccaaatgtcacttcatagcattgtgaccaagcagccctcctgcctctaaacgcactctttatttttatttgagagagaacctcactctgtcgcccaggctggagtgcagcggggcacacttggctcactgcaacctctgtctactcaagcagttctcctgcctcagcctcccaagtagctgggattacaggtgcgtaccagcacactcggctaatttttgtatttttcgtagagaagggtttcaccatgttggccaggctggtcacgaactcctgacttcaaatgatccgccctcatcggcctcctaaagtgctggaattacaggcatgagtcactgtgcctggcctctaaacacatgctttttgttaactgatgcctaaagggaaacatctctttacaaagtggcagctacttagacggctccagctctacagaaatggatagccccggagaccttcacccaaacacaagagctcaagtgtctgttgaagggaagagtgaggagaacagggcctcatgcctactctgtatacgtctgcttagagcaaaattattgttttgttttgtttgagacagagtctcactctgtcgcccaggctggagttggtggcatgatctcggttcactgcaacctctgcctcctgggcttaagggatcctcccaggatgaccaaggttgcaccattgcactcccgcctgggcaacaagagcgagttgtcggagtctcactctgtcacccaggctggagtgcggtggcgcgatctcagctcactgcaagctccgcctcccaggttcacgccattctcctgcctcagcctccctagtagctgagactacaggtgcctgccaccatgcccggctaattttttgtatttttagtggagatggggtttcaccgtgttagccaggatggtctctgtctccaccgcacctggccaaaaaagtgttaaattagaaaaatagaaagaggccgggtgtggtggctcacacctgtaatcccagcactttgggagaccgaggcaagagatcacttgggtccaggagttcaagaccagcctgggcaacatagtaagacctcatcaataataaaaacttttaaaaattagctgggtgtggtggcatgcgcctgtagttccagctactcgggaggctgaggtgggaggattgcttgagcccaggaagttgaggctgcagtgagctgagatcacaccactgcgctccagcctgggtcacgcattgagaccctgtctcaaaaaaaggaaagaaaaataggagaaaaagaggaaccactcataattctatgacgcagagagagctagagttttatgctaccagctttatttttctgcttacagtctgcttgtttcatgtagtaaaatgcaagaatgttttctgatgttcccacaacatggttttattggttgcagagtcacccattgttcatttcataatgagcaatgttgcccaggccggagtgcaatggtgcaaccttggccatcctgggaggaaatcttaagcccaggaggcagaggttgcagtgaaccaagatcacaccaccaactccagcctgggcgacagagcgaaaccccgtctcaaacaaaacaaaacaataattttgctctaaccagtcacgctttgttcatttcataaatcctttctgagcacatgctgtgtgccaagcccttcctcaggccctaggggtacagaccagaggccttgtctaattggggaaggcagataaggagcaaggaagttaacttgtcttatgtcagatggcatagtgctatggagaaaaataaagcaaggagcgaggataaggaattcccaggcaggaggggaggtggcagtttaaaaaatggtggtcacagaaggcctcccagcaaggtgagagccaaaaaacattggaaggagtgggtgttcccatggagaagcttggatacacctccttgggacgtgaaggaggcggctgatgtgattgccctagcactttaccctctcctgctcccttctggatctggaggggccttctggggggctggagggccttaggcctgggctctttccactcatggctctatgttccctcagaattcactgtctgtagcatctgctcctccacagagggaccctggaatggcgatggcactcccgatgcctggacctcaggtgagcaccccctgagcccgtccattgccccaggagactgcttcgcccctagcctcagcttttcagccctgagaaccttacagcttgcctcacacccacccacatcacaggatggagtctgcaagccgaggacagcctcctcgctctatggccaggcctcacacatggctctgccaaatccttccagcctttgggcagaagtgggcttcctgcggcctcctctggcccctgagcttctatggtcagccattgagggcagggtccctgtccttccccagtgcctgcctccttcctggtgtgaatggtcagcccatcctccctctcctgatgctgactcactgctggtgttagaaattgagacccagagggtggggatgctccccacagtgcaggtgctccttccccaaatccctgatagcctgtggagagggcgaggccaaggttgggacccccttcctggtaaatctctctccctcccccaagttcagtttttccctcttcctctctggggcttctgctgagaatgaggccgctcactcggggggtgttgggctgccctttctctgctgggccctgtggatgcagcagtgggcagcaaggagagaggcctctagcagatcatgcaaatgtttctcatctgctgggttctcaccgagcccttgactgcctggatagcagagtatgtggttgcaggaggcggttgtgttcgaggatgtggctgtgtacttcacaaggatagagtggagttgcctggcccccgaccagcaggcactctacagggacgtgatgctggagaactatgggaacctggcctcactaggtgagggcttctgcctttggtcctggggccgggaggtgcgtctgtgttagcttcaaaggaagttggttccattgcagattcaaggtctgacacatttttgaggggaagctggaggctccccaaggagcccctctctgcttcctgttgggcacccactgccagcgtcagcctgcctgaggcttctctcctggggcaggccccccatctccccctggccacctagctgcccccttctgggatagtgaatgttcctgacccactccaagcactctgtgccctgatggcctccagccaggcacctgggcgtcccttctccctcctgtactgatacgtgctgctttccttctctgagcttaggctttcttgttgccaaaccagcactgatctccctattggagcaaggagaggagccgggggccttgattctgcaggtggctgaacagagcgtggccaaagccagcctgtgcacaggtgagtacaaagcacccacagggcgtgtcctgtgctgccaatgtggcctggcctccgggcagctctgcaggtcccttcttctacagtgggaggtgtgtatgtttagctcctcacagcagggccagatttcctactaactgccttgcttgtaggtctaaggtcaaaactaacttatgcaggaagacccaagtgcgagagttttccattttggtgtccccaaggtgtcaggggccgggtctgtgctcacagtgccattacccttgggttgtgtagggaccagccctacagggtctgtgggtttttctcctcatgtgcagagacgagagatcatagaaataaagacacaagacaaagagatagaagaaaagacagctgggcctgggggaccactgccaccaagacatggagactggtagtggtcctgaatgcctggctgcgctgttatttattggatacaaggcgaaaggggcagggtaaagagtgtgagtcatttccaatgattgataaggtcatgtgagtcacatgttcaccggacagggggtccttccctgtttgacagccgaggcggagagagagacaggacagcttacgccattatttcttctatgcattttaatgacttttagtactttcactaattctgttactgctgtctagaaggcagagccaggtgtacagggtggaacatgaaagtgaaacaggagcatgaccactgaaacacagcatcacagggagacggtcaggcctcagcatggctgtgggcgagtttgactgatgtcaggccttccacaagaggtggtggagcagagtcttctctaactaccctggggaaaggaagactccctttccaggtctgctatgtaactagtgccttcccaggcactggggttactgctagaccaaggtcaactaagtaacgggcgtcttcccaggcactggcgttaccgctagaccaaggagccctctagtggccctgtccgggcgtgacagaggctcacactcttgtcttctggtcacttctcactgtgtcccttcagctcctatctctgtatggcctggtttttcctaggttataattgtagaacagagattattattattattatttttgagatggagtctcgctctgtcgcccaggctggagagcagtggcgcgatctcagctcactgcaagctccgcctcccgggttcacgccattctcctgcctcagcctcccaagtagctgggactacaggcgcccgccaccatgcccggctaattttttgtatttttagtagagacgaggtttcaccgtgtgagccaggatggtctcgatctcctgaccttgtgatccaccgcctcggcctcccagagtgctgggattacaggcgtgagccaccgcgcctggccattatttttttttttgagacggagtctcgcactttggcccaggctggcgcgttctcggctcactgcaagctccacctcccgggttcacgccattcttctgcctcagcctcccgagtagctgggactacagacgcccaccaccacgcccagccaatttttttttttgtatttttaatagagacgaggtttcaccatgttagcgaggatggtctcgatctcctgaccttgtgatccgccgcctcggcctcccagagtgctgggattacaggcgtgagccaccacgcctggccagaacagagattattataatattagaataaagagtaatgctacaagctgatgactaatactattcatatatcatcatatctataatctctttctagtataactattcttattttatatattttctttattacactggaacagcttgtgccctcggtctcttgccttggcacttgggaggcttgcttgcccacaggttgctttggtttcctggttccctatggcccatgtgccagggactgagctcagggcagtggaggctgcagaaagaaccttgagctggggaggaggcccccagtcccagaggtctgcgcaggcacctgctctacgcacctgcccagacatgtttgctgagtgcaggaactgtgggtgaactctgaaggagagaggagtaaagaacatggctgtggggtgaggtacaacttgcacctcatgcctggcctgtcttccctgccagaccttgggcctctcctatgggctccccttgagctagcctcccacagtgctggagccattattagcctttttgttcccttctcacccgaaccctgattttattttatttttatttttattatttttttgagacaagagttttgcttttgtcgcccaggctggagtgcagtggtgcggtcttggctcactgcaacctccgcttcttgggttcaagcgattctcctgcctcagcctcctgagtagctgggactacaggcgctcgccaccgcacacagataatttttgtatttttagtagagatggggtttcaccgtgttggccaagctggttttgaactcctgacctcaggtgatcggcccacctcggcctcccaaagtgctgagattagaggcgtgagccactggacctggcctgaaaccctgattttaaaacctctggcaataatttctcaaacctccctacacgtctaacaaagactctgtcttcacttgattgtggtatcatttcacagtgtagatgtttattgaatcatgttgtacaccaaaaatatatacaagttttgttttaagacagtctcactctttcgcccaggctggagtgcaatggctcgatctcggctcactacaacctctgtctctgggttcaagcaattctcctgcctcagcctcctgtatacaagttttatttgtcatttatacctcagtaaagctgggtgttgggggaagacttgggaataaaaaggttatgtcttcaaacaagaagttcgtttgtgagtgtagaggctggatcatccttccgttttctgttccttctctcagattccaggatggaggctgggatcatggagtctcctctgcagagaaagctctccaggcaggcaggactgccgggcaccgtgtgggggtgcctcccctgggggcaccctgtgggggggcaccctgcaccaccccacccgcatggcggtcctgaggacgggtcagataaacccacccacccccgggctcgggagcacagcgcctccccaagggttctgcaggaagacctgggccggcctgtggggagctcagccccccgctacaggtgcgtgtgcggcaaggcgttcagatacaactcgctgcttctcaggcaccagatcatccacaccggcgccaagcccttccagtgcacagagtgcgggaaggccttcaagcaaagctccatcctgctgcggcaccagctgatccacactgaggagaagccgttccagtgcggcgagtgcgggaaggccttccggcagagcacgcagctggctgcccaccaccgcgtccacacccgcgagcggccctacgcatgcggcgagtgcggcaaggccttcagccgcagctcccggctgctgcagcaccagaagttccacaccggggagaagcccttcgcgtgcacagagtgcggcaaggcgttctgccgcaggttcaccctcaacgagcacggccgcatccacagcggggagcggccctaccggtgcctgcggtgtgggcagcgcttcatccgagggtcctcgctcctgaagcaccaccggctgcacgcgcaggagggtgcccaggacggcggcgtggggcagggcgccctgctcggagctgcgcagaggccccaggcgggggacccgccccacgagtgcccggtgtgcgggaggccgttccgacacaactccctgctgctgctgcacctgcgcctacacacgggcgagaagccgttcgagtgcgcggagtgcggcaaggccttcggtcgcaagtccaacctcactctgcaccagaagatccacaccaaggagaagcccttcgcgtgcaccgagtgcggcaaggcgttccgcaggagctacacgctgaacgagcactaccggctccacagcggcgagaggccataccggtgccgcgcctgcgggagggcctgcagccggctgtccaccctcatccagcaccagaaggtgcacggccgcgagcccggggaggacacagagggcaggcgggcgccctgttgggcttcctgatgacggggacgacaggccgaggattcacgctggaagcccacccaagccggcggggccctagcgcagaaattcagaaccccctgtcctgaaggtgaagcaaagtctaaagaaagggccagctcccatcaggagctcggcttcttgctccagccgggcactggggagggaaagggcaccaggcagcccgtggtgtggcctcaggaaccactatcagccaccatttcctggggccttccggaaatgtccaggagcgggcagaagggagagagggaggggcagctatgctcagtccccaaagagcagggcacagggggcgccacagacgcatatgcagctgagctccccacaggccggcccgggtcttcgtgcagaaccattgggcacagccaggccttagcgccaggctccgtgtggcggtcaattccaggtgctgtaaagccgactaacagggtacagggagccttagctggctgccatgtctcctgcctgtaatcccatcactttgggaggctgaggtgggaggtttgcttaagcccaggagtttgagaccagcttgggcaacatggtgaaacttctctacaaaaaatttaaaaataagtcaggtatcgtggtctgtgcctgtacgctgtagtcccagctactcaggaggctgaggtgggaggatgggttgagcctgggaagtcaaggctgcagtgagctatgatagcaccacggcactccaacctggttgacagagtgacaccctgttt

SEQ ID NO: 188 - DNA, 50625 bp, Homo sapiens
acaggcttttgctttctttattcagtcacgactacacgctcctatgtgactgtcctatggtacttggggaccgggcggtccacctgcagcctgggggaggacatccctataatgaacatgctgcctgggcttcagggggccactttggtggccaagatggcatccaggacaccccccaagtgcaccacctgcacctggtggaagccgtgcagctccagcaagcactgatactcgcccaggctccgctccttgccttcagtctgcaccagcatgttcagtgactgcatcagggcgcgctgcgccaccctcttctcctcatccaggagcgtctccaccagcagcaggccggcccctgagggagacagcagagagctggagtcctggccagccaggcggggatccttcagcaggacacaggggacacagcaggcaacaggagctcagaacggtgagcagaggctgctgagaacccttggccagggggcccacacaggtaggggaggggagagagacagagacttgatgcagggcggacagacagggagaaggagatttgatcgaaagatggatggatagatggatgcatcacctgggccttttccggttctcctggatgcatggatgaacagatggtagatgatgggtgggtaggtaggtagaaagatgtatggataggtggacgcatggatgagaaggatggatggatgaacagatggtaagtgatggggaggtacatggatggatggatagatggatgcatgtatgagatggatggatgggtgaatagatggtagatgatgggtaggtaggtagatgagtggatggacagatggatgcatggatgtgatggatggatgggtgaatagatggtacatgatgggcaggtagacggatggatagatggatgcatggacgagatggatggatgggtgaatagatggtacatgatgggtaggtaggaagatgaatagatgggtgcatggatgagatggatggttgggtgaatagatggtagatgatgggtacgtaggtagatggatggatagatggatgcatggatgagatggatgggtgaatagatggtagatgatgggtaggtaggtagatgaatggatggatagatggatgcatggatgagatggatggatggatgggtgaatagatggtagatcatgggtacatagatagatgaatggatggatagatgaatgcatggatgagatggatgggtgaatagatggtagatgatgggtaggtaggtggatggatggatggatggatgcaggcatggatgagatggatggatgggtgaatagatgggtaggtaggtagatagatggatgtatagatggatggatggatgggtgaatagatagtagatgatggttaggtaagtaggtagatgaatggatggatagatggatgcatgcatgagatggatggatgggtgtatagatgatagatgatgggtaggtaggtagacgaatggacggatagatggatgcatggatgagatggatggatgggtgaatagatggtagatgatgggtaggtagatgaatggatggacagatggatgcatggatgagatggatggatgggtgaatagatggtacatgatggacaggtagatagatgaatggatggatatatggatgtatggatgagatggatggatgggtgaatagatggtagctgatggataggtaggaagatgaatagttggatgcatggatgagatggatggttgggtgaatagatggtagctgatgggtacgtaggtagatgtatggatggatagatggatgcatggatgagagggatggatgggtgaatagatggtagatgatgggtaggtagatgagtggatggatagatggatgaatggatgaatagatggtagatgatgggtacgtagatagatgaatggatggatagatggatgcatggatgagatggatggatgagtgaacagatggtagattatgcgtaggtaggtagatgaatagatgggtgcatggatgagatggatggttgggtgaatagatggtagatgatgggtacgtagatagatgaatggatggatagatggatggatgggtgaacagatggtagatgatgggtacgtagatagatgagtggatggatagatggatgtgatggatgggtgaatagatggtagatgatggatcgttaggtggatggatagatggaggcatggatgagatggatggatgggtgaataggtaggtaggtagatagatggatgtatagatggatgcatggatgtgatggatggatgggtgaatagatagtagatgatggttaggtaggtagatgagtggatagatagatggatgcatgcatgagatggatgggtgtatagatgatgggtaggtaggtagacggatggatggatagatggatgcatgcatgagatggatggatgggtgaatagatggtagatgatgggtaggtagatagatgaatggatggatagatggatgcatggatgagatggatggatgggtgaatagatggtacatgatgggcaggtagatagatgaatggatggatatatggatgtatggatgagatggatggatgggtgaatagatggtagatgatgggtaggtaggaagatgaatagatggatgcatggatgagatggatggttgggtgaatagatggtagctgatgggtacataggtagatggatggatggatagatggatgcatggatgagatggatgggtgaatagatggtagatgatgggtaggtagatgagtggatggatggatgaatggatgagtagatggtagatgatgggtacgtagatagatgaatggatggatagatggatgtatggatgtgatggatgggtgaatagatggtagacgatgggtaggtaggtggatggatagatggaggcatggatgagatggatggatgggtgaataaatgggtaggtaggtaggtagatggatgtatagatggatgcatggatgagatggatggatggctgaatagatggtagatgatgggtagatagatgaatggatggatgagatggatggatgggtgaatagatggtagatgatgggtaggtaggaagatgaatagatgggtgcatggatgagatggatggttgggtgaatagatggtagatgatgggtaggtaggtagatggatggatggattcatggatgagatggatggataggtgaatagatggtagatgatgggtaggtaggtagatgaatggatggatagatggatgcatggatgagatggatggagggatgggtgaatagatggtagatgatgggtacgtagatagatgagtggatggatagatggatgtatggatgtgatggatgcttgaatagatggtagatgatgggtaggtaggtggatggatggatggatagatggcatggatgagatggatgtatgggtgaatagataggtaggtaggtagatggatgcatggatgtgatggatggatgggtgaatagatagtagatgatggttaagtaggtagatgaatggatggatagatggatgcatgcatgagatggatggattagtgaatagatggtagatgatgggtaggtaggtagatgaatggatagatacatggatgcatgcatgagatggatggatgggtgaatagataatagatgatgggtaggtagatgaatggatggatagatgggtgcatggaacagatggatggatgggtgaatagatggtagatgatgggtacatagatagatgaatagatggatgcatggatgagatggatgggtgaatagatagtagatgatgggtaggtagatgaatggatggatagatgcatggattggatggatgggtgaatagatggtagatgatgggtaggtagatggatggatggatggatgcatgcatggatgagatggatgggtgaactgatggtagatgatgggtagatggatggatggatgggtgaactgatggtagatgatgggtaggtagatagatgaatggatgtatatagatggatgcatggatgagatggatggctgggtgaatagatggtagatgatgggtaggtaggtagatggatggatggatagatggatgcatggatgagatggatggatggctgaatagatggtacatgatgggcaggtagatgaatggatggatagatggatgagatggatgggtgtattgatggtaggtgatgggcaggtaggtagatgaatggatggatatagatggatgcattcatgagatggatggatgggtgaatagatggtagatgataggtagatagatgaatagatggatagatggatgcatggatgagatggatggatgggtgaatatatggtagatgatgggtaggtagatgatggatggatggatagataataaatgatagacagatgacaggtgacggagcattgttagaaggccagacgcagtggctcacacctgtaatcgcagcactttgggaggcagaggtgggaggatggtttgagcccaggagtttgaaaccaacctgagcaacatagtgagaccctgtctctattttattttttttaaaaaaggatgatagatgtataaagagagacagagacagggtggagagagggaggaagagacagagaagataaaggaggaaggaggagagaagagaaacagagattgatgatgatagatgagatacctaaaaagacacagagaggaggagacagagaggaagagggagaagagagagaaagagagacagaggccgggtgcagtggctcatgtctttaaccccagcattttgggaggctgaggcaggaggatcgcttgagcccaggaagggtagcctgggcaacatcgcaagatcccatctctacaaaatttaaaaaaccctaacagggcatgataacaaatgctggtactcccaaatactcgggaggctgaggcaggaggatcgcttgagcgcaggaggtcaaggctgcagtgaactatgatggcaacactgccctccagccaaatgctggtactcccaaatactcgggaggctgaggcaggaggatcgcttgagtgcaggaggtcaaggctgcagtgaactatgatgacaacactgccctccagccaaatgctggtactcccaaatactcgggaggctgaggcaggaggatcgcttgagcccaggaggtcaaggctgcagtgaactatgatgacaacactgccctccagccaaatgctgctactcccaaatactcgggaggctgaggcaggaggatcgcttgagtgcaggaggtcaaggctgcagtgaactatgatgacaacactgcagtccagccaaatgctggtactcccaaatactcgggaggctgaggcaggaggatcgcttgagcccaggaggtcaaggctgcagtgaactatgatgacaacactgccctccagccaaatgctggtactcccaaatactcgggaggctgaggcaggaggatcgcttgagcccaggaggtcaaggctgcagtgaactatgatgacaacactgccctccagccaaatgctggtactcccaaatactcgggaggctgaggcaggaggatcgcttgagtgcaggaggtcaaggctgcagtgaactatgatggcaacactgccctccagccaaatgctgctactcccaaatactcgggaggctgaggcaggaggatcgcttgagcccaggaggtcaaggctgcagtgaactatgatgacaacactgccctccagccaaatgctgctactcccaaatactcgggaggctgaggcaggaggatcgcttgagtgcaggaggtcaaggctgcagtgaactatgatggcaacactgcactccagccaaatgctgctactcccaaatactcgggaggctgaggcaggaggatcgcttgagcccaggaggtcaaggctgcagtgaactatgatgacaacactgcagtccagccaaatgctggtactcccaaatactcgggaggctgaggcaggaggatcgcttgagcccaggaggtcaaggctgcagtgaactatgatgacaacactgccctccagccaaatgctggtactcccaaatactcgggaggctgaggcaggaggatcgcttgagcccaggaggtcaaggctgcagtgaactatgatgacaacactgccctccagccaaatgctggtactcccaaatactcgggaggctgaggcaggaggatcgcttgagtgcaggaggtcaaggctgcagtgaactatgatggcaacactgcactccagccaaatgctgctactcccaaatactcgggaggctgaggcaggaggatcgcttgagcccaggaggtcaaggctgcagtgaactatgatgacaacactgcactccagccaaatgctggtactcccaaatactcgggaggctgaggcaggaggatcgcttgagcccaggaggtcaaggctgcagtgaactatgatgacaacactgccctccagccaaatgctggtactcccaaatactcgggaggctgaggcaggaggatcgcttgagcccaggaggtcaaggctgcagtgaactatgatgacaacactgccctccagccaaatgctggtactcccaaatactcgggaggctgaggcaggaggatcgcttgagcccaggaggtcaaggctgcagtgaactatgatgacaacactgccctccagccaaatgctggtactcccaaatactcgggaggctgaggcaggaggatcgcttgagcccaggaggtcaaggctgcagtgaactatgatgacaacactgccctccagccaaatgctggtactcccaaatactcgggaggctgaggcaggaggatcgcttgagcccaggaggtcaaggctgcagtgaactatgatgacaacactgccctccagccaaatgctggtactcccaaatactcgggaggctgaggcaggaggatcgcttgagcccaggaggtcaaggctgcagtgaactatgatgacaacactgccctccagccaaatgctggtactcccaaatactcgggaggctgaggcaggaggatcgcttgagcccaggaggtcaaggctgcagtgaactatgatgacaacactgccctccagccaaatgctggtactcccaaatactcgggaggctgaggcaggaggatcgcttgagcccaggaggtcaaggctgcagtgaactatgatgacaacactgcactccagcctgggtgacagagggggactcctatctccacaaaaaacttttttttttttttctgagacggagtcttgctgtgttgcccaggctggagtgcagtggcgcgatctctgctcactgcaaccttcgcctcccaggttcaagtgatgtcctctctcagcctcctgagtagctagaattagaggcgtgcaccactacgccggactaatttttgtatttttagtagaggcggggtttcaccacgtggcttaggctggtctcgaactcctgacctcgagatctgcccgctttggcctcccaaagtgctgggattacaggtgtgagccaccgtgcccggtctcagaaaaaacttcttaaaaaattagctgggcatggtgatgcatgatgcatgcctgtacttccagctactcgggaggctgaggtgggaggacagcttgagcctaggaggtcaaggctgcagtgacctgtgactgctccactgcacaccagcctgggcagcagagtgagacctcgtctcaaaaaatataatagagccgggcgaggtggctcacgcctgtaatcccaacactttgggagtcccagctgggtggatcacccgaggttgggagttcgagaccagcctgaccaacatggagaaaccctgtctctattaaaaataaaaaattagccgggcgtggtggtatgtgccagtaatccagctactcgggaggctgaggcaggagaatcacttgaaccctgggggtggaggttacggagagccaagatcgtgccactgcactccagcctgggcgacagagcgagactccgtctcaaaaaaaaaaaagaagagagatacacagagaaagagagaaagaaggagagacagagggagagaagaatggaagtctcttgaccatttgagcctatggggagtcctgtttcaacgcgcaggtgccaggccctggctctgtgaagataattaaccgttgtctgcaaatattccaggaattctcactggagcaacaacgctgaactcttgagggaggctgagtgcccgtcagattccctcagggccagctggttcaactgtggaaacccaatatgcagccctggcccgaacccctggagccagggtttccagcagccccactgggctccaggagcagcctgggtggacgggggagaaacctgatgtgaaggctttgagccgagatggtgcgtgctgtgtgtgtgtgcacgtgtgtctgcgtagaaacacacagattagatccagctgcagagtccactcatgcgtggatttccctctgcctcggccacccctgagacagcaacaccagcccacggcttcctcctctgcagcctcctcagtgtgaagacctcctcaagaatgaagacttttatcatgagccacttcaacttcacgaatagtaaatatattttctctttaggattttcttttttttttttttttttttttttgagatggagtctcgctctgttacccaggctggagtgcggtggcgcagtctcggctcactgcaacctccgtctccaggttcaagcgattctcctgcctcagcctcctgagtagctgggattacaggcacccgctatcaagcccggcttattttttgtgtttgtttttaatagagacggggtttcaccatgttggccaggctggtctcaaacccccgacctcaggtgatccgcccgcctcggcctcccgaagtgcggggatgacaggcgtgagccaccacacctggccacactggccaactttaaatacagcagatttaccctccacaatttagcgggcctctcacccagacgctggacctgccaacctccaaagtcacataagccaattctttttttgttgtggttgttcttttttgacaccgaatctcactccgtcgcccaggctggagtgcagtggcgcgatctcggctcactgcagtctccagctcccgggttcaagtgattctcctgcctcagcctctgaagtacctgggattacaggtgcgcactaccacacctggctaatttttgtatttttagtagagacggggtttcaccatgttggccaggctggtctcgaactgctcaccccgggtgatccacctgcctcagcctcccaaagtgctgggattataggcatgagccaccacgcctggctaatttttgtatttttagtagcgatggggtttcaccacgttggccaggctggtctgaaactcctgacctcaggtgatccgcccgcctcggcctcccaaagcgctgggatgacaggcgtgagccaccgcgcccggcctccttgtaaaacttgaacccaaaatactacgtcttaacaaaaacagctaacctgacgatgggctctcacctggcttgcagctctcggcgaccctgctgagtaacttgtggactttgtcgtctggccagtcatgcaggatccggcacaggacgtacagctcagcgctggggagggggtccctgaaaaagtcacctggtttaaagacaaaacgagatacgtccgtcaggtatggaagaagcagtcctccccggacagatcctgggacggccacccgcatcctaaatcagggacagagaagagaggggtgtgggcgggaatgggtcttcctgaagtacatccccgtggggacttgaacagagctccatgaggagctggttagtgatgtcacgcccgtgcggtttgactcgggctgagaaaacgctggggacagtggctcacacctgtaatctcagcattttgggagcctgaggtgggcagattgtctgagctcaggagttcgagaccagcctgggcaacacggcgaaaccccatctctactaaaaatgcaaattagctggacaggggtggcgggcgcctgtcatcccagctacgcgggaggctgaggcaggagaatcgcttgaacctgggaggtggaggttgcagtgagccgagatcgcgccatcgcactccagcctgggcgacaagaaggcaagggaggaaaaaagcagggaattcaggggcagcacctgggcgaggcaggcagagtcggcgcacatgggcgtgtgccagggagagtcggggccgcactgccggtgagtgggcaatggcagggccttctctggtgatcccctgattcaggcgccccaggagggttgcctgttgcggggggcgcatgtagctgcacgcccctctgtaattgctgaaataaaaagatggtctgctgtagtgcagtgaatggtgtccccttaaaagatatattcaggtgctgaccctcagtcgctgggaatgggaccttatctggaaatagggtctctatggatgtcattgagtaaagaatttcaaaatgagatcatcctggagtagggtgtcccctaaatccaatgacaggtgtccttctaagagacagaagaggagacagacacagaggagaaggccacgtggagacggaggcagagactggagtgatgcggccacaagcccagggacgcctggagcccccaggagctggaagaggcgggaaggatcctcccctagagcctctcagaaagaatcaaacacaactgcaatgggttgggtggtgacgtccaaaagatctgtccaagtcctaagccccagaacctgggaatgggacctcatttggataaagtttctttgcagatgtaattaaggatctggagatgggatcatcctggagtagggtgggccctaaatgcaatggcaggtgtccttctaagagacagaagaggagacacacagaggagaaggccacgtggagatggaggcagagactggagtgatgcggctacaagcccagggacacccggagcccccaggagctgggagaggcaggaaggatcctcccctagagcctccagagggagcacagccctgagatgccttgatctcagacctccggtctgcaggacagggagaggataaatagcaagctgtgagttgcatgaggggaaagaaggggcgggagagtgtgcggtgggaagtctccagagctgttttcccccagctgcgaggagaaggtgctctttcagggctcatgattttaaactttagcatttccggccgggcggggtgtaatcccagcactttgggaggccaagacgggtggatgacctgaggtgaggagttcgagaccagcctggccaacatggtgaaaccccatctgtactaaaaatacaaaagttagccaggcgtggtggcgggcacttgtcaccccagctactcgggaggctgaggtgggaggatcccttgaacccaggaagtggaggttgcagtgagctaagatcacgccactgcactccagcctgggtgacagagcgagacaccattcaaacataaataaatttcagcatttctgtctctgcagatctggcaaatcagaagcacagctatcatgatgtcctgcaggaggagctgtagggtggttgcgttttgtttttttaaaaacgagaaaagcatccaggaacctctgggggagggttgtggaggtccccagcacctgtgcccacaggcctggccgctgtcggatggtgctgagttacagcacgtcagctgtctctttttttatttttttattttttttgagatggagttttgctgtgttgcccaggctggagtgcagtggcgcgatctcggctcacggcaagctccgcctcccgggttcaagcgattctcctgcctcagcctcctgaataggtgggattataggcacccgccaccatgcctggctaatttctgtaattttagtagagatggggtttcaccatgttgctctggctggtctcaaactcctgacctcaggtgatccacccgcctcagcctcccagagggctgggattccaggcgtctcctgtcaatccgtcctggcctcagcagctgccacctggaagttctccttcaagtctaacctaaggccacactgtgacggctctcgggtcagttccttccgtgacctcggcaccgtggatgcccatgaatgctgatctcggctgttccccatctccactcccctcacgtctcggctacttgcactgatgataacttcacacagtcgtccacctgtttatttttatttatcattattattatcattgtctttttttttttgagatggagtttcgctcttgttgcccaggctggagtgcagtggtgagatctcagctcactgcaacctccgcctcccaggttcaagcgattttcctgcctcagcctcctgagtagctgggattacaggcgcccgccaccacgcccggctaatttttgtatttttagtagagatggggtttcgccatgttggccaggctggtctcgaactcctgaccacaggggatccgcccgcctcagcctcccagagtgctgggattacaggcgtgagctactgtgcccagccttgtccacctgtttggagatgccctcgtgtctgtgtggacccgcagagagacacgcacaggcagacccacggacgcacagacacagacacaggcacacacacatatacccatccagatgcacagaaatgcagacacaaaggcacacatgcaagcacacgccacaagacatgcacacacggacacatgcaggacacagatacactgacaggtacacacatggacacacagatacagcaagacaggcacacacacacacacggacacagatacagtgacaggcacacgcgcacagagacagacatgcacagatgggcacactcacgcacggacacacagtgatacaccaacaggcacacacagacgcagacatgcacagatgggcacacacacatggacatacagatatagcgacaggcacacacagacgcagacatgcacagcaacaggcacacacagacgcagacatgcacagatgggcacagacagacacgcacggacacacagatacaccaacagacaggcacgcacacagacgcagacatgcacagctggacacacacacacacggacatacagatacagtgacaggcacacacagacgcagacatgcacagatgggcacacacacacacggacatacagatacaccaacagacaggcacacgcacataaacatagacatgcacagatggacacgcagacacacatggacatacagatacagcgacaggcacacacacacggatgcagacatgcacagatgggcacacgcacggacacacagagataccccaacaggcacacagacgcagacacacagacatacacacatatacccacacagacgcacagaaacacacataccctcacacatatgcaagcacacaccacagagagttgcacacacacaaacgcagatgcagacacagagacacattcttacgcacgcacacacaaggacataccacacacagtcagtcatgcacacacagacacatgcacacacagacgtacacacaagcacagcagtgacatgcacacacaccatgcacacagatacagatgggcacacagacatgcacacacagacatgtacacatatatccacagacacgcagacacacataccctcagagacatacacaccacagaggtgcacacacacacacggactcagacacagagacattctgacgtacagacacgcatgcaaggacataccacacagagatgtgcacacacagactcagaaacacacagagacacagacacaagcacagcagatgctcacatatccacacagacacacaccatgcacatagatgcagacacacagacaagcacacccagacacatgcacacagacacacaaccacagcagtcacatatgcacacaaccaccggcccacagcatgcacacagatgcagacgtacacacagacacatgcacacagggacacacaaccacagcagtcacatacacacacacacctaccagcacacagcatacacacaaatgcagacacagacgggcacacagacgcacatacacagacatgcacacatatatccacacggatgcacacacatcacctcacagaaacatatgcaaccacacaccacagagacttgcagacacgtggacacacagtctcatgcacagacacacacacaaggacatactacacagacgtgcacacacagttacatatgcacggaagacacacaccatgcacacagatacagacacagacatgcacacacacacacatgcacacagacacacaagcacgacagtcatatgcacacagacacccaccggctcacagcatgcacacagatgcagacacacacacacagacatgcacacatatacccacacagacacacacacatactctcacagaaacatatgcaaccacacaccagagacgtgcacacacatgcggatgcagacacacacacacacagacatgctcacgcacagacatgctccatgtcacaggtatgctccagggcataccacacacatgcacacagagagacacacacacacaagcaccgtagacagtcccatttgcacacacatacccaccatggaaacgcccaggcagaaacacaggtgcacacacagccatgccctctgtctagaaagagatgctgcagtctggaaaaggttagcagggtgaacaggaggagggctcacctgctgcgaagtggatctgcactgcctgcggtccggggggttggaagtgggcggccagctcgataatgtctgggaggtcaaacacagtcacctgcatacgagggtactcacgggccagctctcgggccagtgcacccgtgcagcctgcggggaagcaaatgcatgctctgtggctgggtcgtctatggaactctgacgactctccaaagctcaactggggcagaagtaatgttcaagggcatggcattgattcccatgctggaagggaaagccagtggtggggagctcgctggtatcccagacaagactgtacaagcaggtgagtgtgggggcacagacctgcagggaaatccttccagcccaggggtggagggctgtactcccttctccttcctgccgtggggatgtagacacaatggccggtgctacagcagccactctgggccacgtgtagggggcacagacctacagggaaatcctttctgcccaggggtgggggctgtactcctcccttctccttcctgccatggggatgcagacacgatggctggtgctacagcagccactctggaccacaaggaggagaggcattcagaggttggggaaatgtaagctgatggtgtgagaatcgtcccaggccccgatcccccagcagcccttgggaatgtgtctactgctccacccactgtccagggctggggtggggtggagggtgagtcaggatataatcagacttgctgaggggaatccaggggttccaaggtgctctgcctcagctccgcagccaaaagagagggccccggagtttctaggggggcatttaggcatccccggggtcctcctggaacttgggaatatccacccatgatctgggactcagcctggcccggttcaggtcgttatcaggtttgtcaatggaaaaaggcagttggtaggtgtcctgagcagggaagatacctgtggcttaataaacgaaagtaaggagagccctggcgggggggccacccacctcccacgtcgcaggcggaggagaagcgggacagattgaaggccgtggccacctggcacgcagtcagcttcgtcatgccgtgcatggcccgcatgaacctcagccgcgtctccgggctctggtagtacgcatcctggaacacagcaggtgcttaggggcaccagagaacacggggcgagggctcgcccagcctctccctgggggtcggggggagaagtgcagggctccagagcgtgggggctcagccgcgcctgggctgcagagcgggcttcatgccacagctgtgtgggctactcttgtctgtgtgggggctgggctggctggggacagaggaccccaaagtggtggacgatctccttggaatcacttggtccacaccacagcctgaactccaagcgtctgactttcgcagtaggcttttcacaataaagcttttcaccctggaggctccgggtggcccacaaacacctcactggagaaaaccaggagagaagccacaatgtctctgcaggtgccccggctcagccttcaccacaatggtgcggtgtgcagagggggctcctccgagaattctggtgtgcagaggagaagctcctccgagcttctccaagtccccccagtggcacctaccccgggtcccagaggagcccaggctcatcctggctcagtgctgtgtccagggttcgcctggacatcccgtccctgcagggcaagcaagcccagctgaggatgcttctgagccccgctcccagcaggacagccggtctccatcctggctccctaaatctcgcgggggctccccggccctcccctgcgtgggtggcaatcatggggctcagggatctgtcctctgcgatgcccacgctggctgctcacgccagctcagggcccctgtccgtgcctctcggcttctccaccactggcttctctctctgactctttctcccttggtctctgtctgtctgtctctgtctccgtctgtgtgtctctgtcttcctctttctctctctctgtttctgtctcctgtctctgtttctttctatctccctctgtctctgtctctatgtctgtctcctgtttctgtctctatctgcctctatctctgtctctccaagcctccctgtctctgtctcccatctccctctatgtgtctgtctgtctccatctttgtttctgtctccctatctctgtctccgcctccctctgtctctcaagtctccctgtctctccatctctctccctatctcactatctgtctcccatctccgtgtctgtctcactctatctctgtctctgtctttctgtctccctgtttctgtctccctctatctccctgtctctgtctgcctccatctctgtctgtctctgtctccctctatctttctgtctgcctatctctctctctgtgtctccctgtctgtatgtctctccccaacatctgcaggaagcccccggctccctggggctcatctctgcatcacacacacacaccctgactccgtgctcactgccacagaagctcggccagcgctgccaaggaggcatgaggccacggccagccgagcccacagcagactccccacgcctggctggcacagccctgcagaccgagacccacccatctgcacaggccccacggaccccaccatatctcacacgtccacctcaggaaggttctgggcggggaaaggggaaggaggggcgagaggatgcagggagcgctttgcaaacagcggcctcagataagcaagtgtcagttccattgaagcaaagaagaaacagggcattcatttaaggcagcctgtccaactccttcctatttctatttttcagacagagtcttgttctgtcacccgggctggagtgcagcagcaccatcacggcttacactgcagccttgacctcccaggttcaagtgatcttcccacccacctgggcctcccaaagtagctgcctaatcatacctggctaatcgttaatttttttttttttttttgagatggagtttcgctctgtcacccaggctggagggcagtggcgtgatctcagctcactgcaaccaccacatcccgggttcaagtgattctcctgcctcagcctcttgagtagctgggactacaggcacgcgccatcatccccagctaattttttttttgtatttttagtagagatggggtttcagcacgttggccaggttggtctcgcactcctgacctcaggtgatcagcccaccttggcctcccaaactagctgggattacaggctcatgccaccatgcccagcctaactgttaattttttgtagagatgggggtctcactatgttgcccaggctggtctcaaactcccgggctcaaatcatcctcccaacttggcctcccaaagtgctgggagtgacaggtgtgagcccctgagcatggccttcaaacctgtttctaggaggaaattctattttcatcagctgctggataacagtggaggatgtctaagttgcacctgttccagggctgagtgacacaagagccacggcactaagttctccaggcagaacgagccaagcctttgggatctgtcagactggagacagactggtcaaggtgcctactgatctgtgtgtcaaagtgttttagcaaaatgcacgctagacggaaaggtgtccgcgggggtgttatgctacctggaacagatcttccgccttcttccccaacgccctgtggtgctggtttgttccctctcggatggcaaactccaggtatgtaaagaggttccatgtgaggtcattattgtgcatgatgaagccgtgcagagagtattcgccatccgatgccaggtagacgttcgctgtctctgtgttactgtaacctggagaaatggggacagtcgtgtgacctcctaacgagaaaacccaaggaaacctgaccgtaggggatgtatcattgagatgttaaaataaacatcacccatctgactatagcaaaccgtacactcaaggaaacctgaccataggggatgcatcattgagatgttaaaataaacatcatccatctgactatagcaaactgtacactcagggtcagctgggcaggaaaacagcagccaccacgccccagctgtcaactgctgtaactgttacccactgaggctgatcctttcttcatgatcgtggccacgctcaagttcccagttatgcaggcaaacacccatctagatgtggctgtggaggtgtgctgtagctggcgtttgcatctaccatcagtttgactttaaggagattaaccccccaaaatgtgcattggcctcatccagctcattgaaaaccccagaagcaaacattgggctttcctggaggagaaattccacttgaagatggcagcagcagctcctgcctgagcttccagcctcctggcctgccctgtggattttggacttgccagcctacacaatcacgtaagtcctcaagataaatctcctaggttatatcctaggggttctgttaccctggagagccccaaatgatacagggaacttcattctccacccacttcatgcccaggtcagctgtccatagacccagtccccaagctcccttccaggatgccccctcccacagaatgggaggctggaaggtggagaagttgttggtggagacccgtatatggaaacagatggcctcgcaccactccggtcctcctatgtaagaaacagccctgtgttcatgttaatgatgaaatgttactgttttcccaccgagctgaccctgagtgtacggtttgctatagtcagatagatgacatttattttcatcatgaataaatgatgagacctatggtgaagcaggagcagcctctgcagacgtggaactgctcctaggactcaactgcacaaagcgttgtcaaaaggagttggaacaagcttgcatggtgccggtgatgaaaagcctttctccatattcatcattattttctttcttttaattttttaattttttttgagatggagtctcactctgtcccccaggctggagtgcagtggcacgatctcagctcactgcaagctccgtctcctgggttcatgccattgtcctccctcagcctcccgagtagctgggactacaggcacccgccaccgtgcccggctaattttttgtatttttagtagagacggggtttcaccgtgttagccaggatggtcttgatctcctgaactcgtgatctgcctgccttggcctccccaagtgctgggattacaggcgtggcctattcatcattattttcaatacgggagaatggtcctgaactgctctggctggggaagatgttctggcttctatgttccagcctctaaggatatagtcacatgtctctgtggtaagggcacagcctttggagcctcaaccagggcatgctttgtctcctaatcacagaagcacagccacctctgcccaggtgtcatctgttgtcctgcccttcccaggctactcaaggacttggtcatgtgctctctattctagcaccatgctgaagagttctgttcaattcagaaaacacattgtcatccatccatccatccacccactcacccacccatccagttatccactcacccacccatctagtcatccacccacccatctgctgatccacccattcatcactcatctatgcattcccccacccatccaatccaccgatccacccatctacccactcatccatccattcccccacccagctacccatccagcaatccactgatacatctatccatccatcctcccatccatccgtccacccacccatccatctattcacccaccctcccaatcatccacccagccatgcacccatccatccactcatccatccattcacacgcccacccatccacatgcccactcatccatccatccacctacccatccatctattcacccatccactgatggatccactgatccatgcacccatgcatgcatccatacatccacatccatttatccattcattcccccacccatccaatcactcatccatccatctgtccatccatccatccatccacccacccacctacccatccatccacccatccactgatggatccactgatccatccacccatgcatgcatccatccatccacatccatttatccattcattcccccacccatccaatcactcatccatccatccatccacccacccacccacccatctgttcacccaccctccccatcatccacccagccatgcacccgtccatccattcatgcactcatccacatgcccactcatccatccacccatccaaccacccacctacccattcatccatccattcccccacccagctacccaaccaccgatccactgatatatctgttcatccaccctcccatccatctgtccacccacccatccgtctattcacccacactcccaatcatccacccagccgtgcacccatccatccactcatccatccattcacacgcccacccatccacacgcccactcatccatctatccacacatctatccactcacccatccatccacacatccatccatccatccatctgtccgtccatccatccatccagccacccatccactcacccacttatccatccacccatccatccacttacccacccatctatgcactcatccaccgattcatcgatccatccatccatctacccacctttatccatccagtcatccacccatccatccacacatccttccattcacacatccatccatctatccactcacccactcatccatccacccatccatccacttacccacccatctacccacccttccatttatccatccacctctccatccatccatctatccatccacccacccacccatccatccacccatccactgatccaccaatccatccaccttcccatccatgtatctatccatccattgatcaatccatctgtccatccatccatccatccatccctcctcccatccatctatccacctaccatccatccatccatccatccatccttcctcccatctatccacctaccatccatccatccatctatccatccatccatttatatatcaactctacccatcatctatgtatctgtcatctctctatcgtcaatctatatcaatgtatctatgcatttatcatctatctatgtatctgtctacccatccatctacgttatttgtctataaaaataaataagcaactaaatcaatgtctgtgtacaccgtattgggttctgtttctcaggagaacatggactgatacagcccctttgagactagagcccataaggaggtcacgcttctcctatgtgctcgcggctgccactgttccctctctgtcattcaccctctgcttctcaacctttcgggaaaagcagcattcctgagggcagagggacagaaggtgtgggcctccttcctcgctctgcccaggctccaggtcaccttccctcagtgacttccacctgcaaagatcctcagagcaaaacccgctgggtcctgtcaccttgctctgtcttctccaggagccccatggcagcacagatgtccagaagcctctccattccacacgcagaggcgtccactttgctggcaatatccgcagccttctggggtgcttcatcttttaacaaatcgaacaccttcagtttgcaagcggtgagcaggccctgttaaaagcaagtgcagagagactcattaagtcccttgtccagtactttctactcccacagactcaaaagatggaggccaacgctgtcggaagtatacaacttggccattgagccttctttcacagagaacggtggggatttataggatcaagtccccagctataaaacaaggtgtacacaaggaaaaagcacatcaacgaatatcatgcagaaaaactagcccatgggagaaaaatcaacatgctgccgatatggactgagttcaaaacccagatgttgaactcctaatccccccagtccctcaggatgtgactgtatttgtaggcagggttttaaagaagtgattcaggtaaaatgaggtcatttgggtggaccctaatccaataggactggggtccctataagaaaaggagatgaggacacagacacacacacagggacgaccctgtgaggacacagggagaagacagcatctccaagcccaggagagaggcctcaggaggaaccagccctgcccacacgttgatcttggacctccagcctccaggactgtgggagaatcaatgtctgttgtttataaaccacctggtggtgatttaataatcaccacttggtaaattagaggcacagacggaatgtgctgtaaccacctttattccttattcactgcatgttctctctcctgatgatgaatggcaggaggtgtcatcagcccgtctccctgtctcccaaagcctgcgtccctcctgcacccgacatccccacctctgcttcccggaggacgccctgtgagggacccctggtgttgggagggctgcatcccttctaggctgccaccgtgaggggcccctgaacagaacagctgaaagatggggcctcaggccgggcgcgctggctcacgcctgtaatcccagcactttaggaggccgaggcgggtggatcagctgaggtcaggagttcgagaccatcctggccaacatagcgaaaccctgtctctactaaaagtacaaaaattagccgggcttggtggtgggcgcctgtaatcaggaggctactcctgaggctactcaggatctcctcttgagattcttaattacatctgctaagacccctttttaaaacaaggtcccattcacagattctggggatcaggctatgaacagatctttcaggaggaccacagttaggaggctgaggcaggagaatcgcttgaacccgggaggcagaggttgcagtgagccgagatcatgccactgcactccagcctggatgacagagccagactctgtctcaaaaacaaaaacaaaaacaaaaaaaagagaaaaagaaaaaagggtctttgcagacgtaagtaagctaggggacttcagatgagttggagtcagtggattagggagacctcaaaatccaatgacaggtgtccttctaagagacagaagagacacagacacagaggagaaggccacgtggagacaaaggcagagactggagtgatacggccacaagcccagggatgcctggagcccccaggagctgggagaggcaggaaggaccctcccctggggcctccagaaggaactggatacatctgtagtggactgaactgtggtcctcctgaaagatctgtccatatcctgatccccagaatctgtgaatgggaccttgttttaaaaaggggtcttggcagatgtaattaagaatctcaagaggaaatcatcacgaagaagggtggactccaagtccaatgacaggtgtccttctaagagacagaggaggagacacagacacagtggatgaggccacgtggaggacgtggcagagactggagtgatgcggccacaagcccagggatgcctggagctgtcaggagctgggagaggcaggaaggaccctctcctagaaccttcggagaaagcatggccctgagacaacctgacctcagactgccagcctccaggacagtgagaagtaaattccctttgatttaagccgagtgtgtaggctcatttgtgaaatgtggcctgaggagacagacacaggtaccttggatagcataaagccctcaatcagctccaggaggcgtgtcgggaacggaggcagggtctcccgagtcctgtgacactcagcctctgccgtggcctgtcccgcctctcccgcctcggccttctcatcgcggctgcccgcgtccctctgagtgggctccgagccgcccccctccacgtcactgaggtcttcgaaggtgtccgcggccgggatggagtcgtgcttgacactccgccgcaggtcctccggacggggcgggtagtagagcttcaccagctgcttgcagaagtggttcagcgggaatcccaccacgttcagaaagtccccgtgtacggactccaccagcatgccgcccagggcctggatcccgtagccgccagctttgtccctgggtgggcaggggaaggtaagaggtgacaaggaggagaaaagttcctgggtctgaacatttcacggctgggaggcggaggtgggtggatcacgaggtcgggagatcgaggccatcctggctaacacagtgaaaccctgtctctactaaaaaaaatacaaaaaattagccaggcgtgggggcaggcgcctttggcatctcaaaaaaaaaaaaaaaaagaaaaacaatttcacagcaaggctgggcgcaatggctcacggctgtaatcccagcactttgggaggccgagacgggtggattacttgaggtcagaagttcaagaccagcctggccaacacggtgaaaccccatctctactaaaaatacaaaaattagccgggtgtggtgtggtggcacacgcctgtaatcccagctacccaggaggctgagacaggagaatcacttgaacccaggaggaggaggttgcagtgagccgagatcgtgccactgcactccagcctgggcggcagaggaagactccgtctcaaataaataaataaataaataaaatttcatgtgttaaatgggatgttttgacatatgtatacatgcgtcatcattaaatcaagccaattatcccattcagcatctcatctacgaattgtgtgtgtgtgtgtggggagaagacttcagatctagtgtgctggcaatttaccagtaagacactgttcctataaaccacagtcacaggctgtaaagagccttgaacttcttcctcctgtctcacttttttattttttatttttattttttaaagacagagtctcgctctgtcgcccaggctggagtgcagtggcgcgatctcggctccctgcaacctccgcctcctgggttcaagcgattctcctgcctcagcctcccgggtagctgggatgacaggcacctgccaacacacccggctaatttttgtatttagtagagacggggtttcaccatgttggccacgatggtctcgaactcctgacctcaggtgatgcgcctgcctcggccccccaaagtgctgggattacaggtgtgaaccaccacgtctggccctcttttctctttcttattttatctatttttttttttcaagacagggtctcactcggttgctcaggctgaagtgcagtggtacattcttggttctctgctccctcaaaattctgggctcaaatgatgctgtaatctcagcctcccacgtagcagggacacactcagctagttttatcattttttataaagatggggtttcactctgttgcccaggctggtctcgaactcctgggatgaagtgatcctcccgtcttggcttgagctactgtgcccggcctgtctttctttaaatgtatgtaaacattaaagtatgtatgaaagtgcaggtgttgggctgggcgcggtggctcccagcacttcgggaggctgaggcaggcagatcacctgaggtcaggagttcgagaccagcctggccaacatggcaaaaccccttctctactaaaaataaaaaattcgccaggcgtggcggtgggtgcctgtagtcccagctacttgggaagctgaggcaggagaatcgtttgaaactggaaggtggaggttgcagtgagccaagatcgcgccactgcactccagcctgggtgacggaggaagactccgtctcaaaaaaaatttcatgtgttaaatgggatgttttgatatatgtatacatgtgacatcattaaatcaagccaattatcccatcgagcacctcatgtacctattctgtgtgtgtggggagaagacttcagatgtagtgtgctggcaattttccagtaagacactgttcctgtaaaccacagtcactaggctgtaaagagccttgaacttctcccgtctcacttaattttttttttttaaaagacggagtctcgctctgttgcccaggctggagtgcagtggcgcgatctcggctcactgcaacctccacctgctgggttcaagcgattctcctgtctcagcctcctgggtagctgggattacaggcacctgccaccacaccgggctaatttttgtatttttagtagagattgggatttgccatatccaggctggtcttgaacttctgacctcaggtgatccgcctgcctcggcctcccaaagtattgggatgacaggcgtgagccaccatgcctggccctgatttaaatcttgtatcctttgaccaagtgcaactgttttatattccatataagtgagatcctgtggtatgtgtcttcttctgccgggcttatttcaattgatgtaaaatcctctaggttaatatacatatatattacgcagactccatctctacaaaaactaacaataaaatcggccgcgtgtgttggtgcgtgtcctgtggtcccacctactcaggaggctttggtggaaggatcgcctgagcccaggagttcaagaccagcctgggcaacatagtgagaccccattgctacaaaaaatagaaaaaattagccaggcgtggtggtatgcgtctgcagacccagccactagtggggctgaggtgagaggatcattttgactcaagaggctgacgctgcagtgagctatgactgtaccactgcactccagcctgggtgacagagtgagaccgtgtctcaaaaaaataaataaaattatttatataaatatataaaataaacatatattttatacaaatgtatttatatacatatatttatatatttatatacttttataatataaaaatatattttatataattatatatttatataacacataatacattatatattatatataactaatatgtattacatatatttaattaatatataatttacatataatcacactttatattattatgtaatatgtattaatatgcagttacatatattaatcatatttaatacatattacatattatccatatattcatatatttctatattatataaatatataattatattttataatatataatcattttataattatatatataattatatataatttatatttatataattgtttataattatatataattatatatcatttataattaattatatataattataaattatatttatatataattataaatatatgtaattatatatttatatataaataaaattaaatatataaaatatataaaattatatattttatatataattataaataattataaatataaattatataatttatatataattataatcgattataactacctattatataatctattttaacagttatataacctatcatataatctattataacagtatatattataatagatggtatatattacattaatattaatcactacttattaaaattaatcattaaaaatcattaaatttcaatcaaaagtgttaatatataatctatattataatatctatatgtaatatagtatacatattacagtataatctattatagtatataatacaatatattataaatatatattatataatttgtataatgtagattatatataattaatagaatatataatgtggaatacataaattatatataattgtaaatatatatcatgttacattatataatgtataattatgtagacattatatgacatatgatgtagataaatataatacatataaacgcaaatggtgggtgatgaagtgaagctgattggtgcacgcatacttcccgtgctcaccaatctgtggacgggacgacaggtagaatcacctcttagggtgactttggatcacagagtttattcgtgttaattgcagccagcgtcctgggcacagacctctggggtctcctcctcccaccacgtgaactcctctacccctgcccagcgcctccccagtccccaccgcagcccagcgttggctcccaccctgcccctctctgtcctgggagtttgcctctttgagcctccatgggtcagtgtggtcgtgaagggtttgtgcttctgagccgggcggctctccctgtgccacacggcccccggagcggggcctccttctttcccaaaggctgggtgggacaccccacgtgtgagggtggccaggcttccacacgtgtcccccgtccccccaccgcccccgagactcacatgggctccccgctgtggacgtattcccagagcagctcctcggacagctccgagaacttcaccttcgtttcctcgtagaattccgagaccctggtgtccagctgatggtctgcaaggacacagccgtgggggtgagcgtggacgccagcttgtcacctccgtgccctgacagctgcgtggctgtgctgtggaggtgtgtactcgagcgcagcgcacagttcagatatggatgcttcatgggagaataaggttcatttcggacaagaaaagggagaaaggggccgggcgcggtggctcacgcctgtcatcccagcaccttgggaggccgaggcgggtggatcacgaggtcaggagttcgagaccatcctggctaacacggtgaaaccccgtctctactaaaaatacaaaaaattagccaggcctggtagtaggtgcctgtagtcccagctactcgggaggctgaggcaggagaatcgcttgaacccgggaggtgcaggttgcagtgagccgagatcgcgcccctgcattccagcctgggccacagagcgagactccgtctctaaaaaaaacaaaagaaacagcagtttgggcggccgaggcggatggatcaccagaggccaggggttcgagaccagcctggccaacatggcgaaaccccgtctctactaaaaatacaaaaattagccgggcgtggtggcatgcacctgtcatcccagctactcgggaggctgaggcaggagaatcgcttgaacccgggaggcggaggttgcagtgagccaagatcacgccactgtactgcagcctgggcgacagagcgagactctgtctcaaataaataaataataaaagaaacagatgtttggtctgtgcctcagggtccggacacagagcccctgaatcccggggaatctgttgagtgacaggagcgaaagcaggcgttttgctatgtggtgacaagcccctttcatccgcaggggaccttatgttaatgaggggccttttggaaagggcaggctttggttgtcatgggaacagggggagggggctggagatggagtttgctccccagtggcggatgatgtcgttaatcctggccttttaagagacccagaagggaccgcgcgcggtggctcacgcctgtcatcccagcactttgggaggccgaggcgggcggatcacaaggtcaggagatcgagaccctcctggctaccacggtgaaaccccgtctctactaaaaaaaaaaaaaaaaaaaaaatagaaaaaattagccgggcgtggtggcgggcccgtcgtcccagctactcgggaggctgaggcaggagaagggcgtgaacccgggaggcggagcttgcagtgagccgagatggcgcaagtgcactctagcctgggcgataaagcgagactctgtcacaaaaaagaaaaaaaaaagagacccagaaggacagggttcagggagcttctggtgggtgaacacatcagggtgttggcagagctgtgccacggcgggcatggaggctccatacatcctgcacccagcaccctgcgctgtgcctggcttctgtctggcacttcctgacctgctccttcataacaaaaccccaagctgggaaggaaagtgctgtcccgagttctgtgagcccctcgagcaaatgacccaacctgagcaggtgcttgcaggagccagcagtgagcggcaggtgggtgagaaaactacaggtgtgaccagggatatggggctgggattgtgcgtggaggtcccatgggacccggcccttcacctgtgggatctgcgctaactccgacggctactgtcagaactgactgaattctacgatgcctcctggtgtccgccaacaagctgggaatgggttggtgcaggaagaacccagcaatatggtgatacaactgcctgggccgggcaccgtggtgcacacctgcagtcccagcaatatggtgaacacctgcagtcccagcactttgggaggctgagatgggaggatttcttcagcccaggagttcgagaccagtctgggcaacatagcaagaccgcacctctataaaaaatacaaaaatgagccaggtgtggtggcgtgtgcctgtagtttctgtgactgtaggggctgaggcgggaggatcgctggagctcaggaggtcgaggctgcagtgagctatgatcacaccactgcactccagcctgggtgacagagggagaccctgtctcaaaaaaaaaaaaaagaaagaaagaaagagaaaggccgggtgcagtagctcacacctgtaatcccagcactttgggaggctgaggcgggtggatcacctgaggtcaggagttcgagaccagcctggccaacatggtgaaaccccgtctctactaaaaatacaaaaattagccgggcatggtggtgggcacctgtaatcccagctactgaggcagaaggatcacttgaacttgggaggcggaggttgcagtgagctgagatcgtgccactgccctccagcctgggtaagagagcgagactccatctcaaaaaaaaaaaaaaaagaaagaaaaagaaaaagataaaaccacacgttttcctttgtcctgcagacttccaaatcggcggacaactttcccaagcaggacataggcacaaacccctccacaggtgggggtgagcaaccgtcctcctccctcaagccaagggtcccgagaatgtcccgggtccttgtctcggcctctggggctaccccgaaacctgggccgcggttacctttgctggagcagtggacgatcgcgacacctgtgaacacgctgtgttctctcccactcaacctgtaagacaacaacgggtgaccacgtgaccatgctgtgacccgtgggagctacaaagcgagtttctcaaaaccaggggaggcagcgaggcgtccttaatcctggatccgtccccagcatcttctccccgatcgtcccgctgtggggtctccagggaaacctttacggagaggccgagggaaggggtcacaaatcccaccagcagtggccctgacgggaggcgccaggccaggcagctctcagctgggcctatggcgggcagggggtgcatctcttccacgtcctgggatggggatgacgtcccaggctacgggctcaggtccaggatgcccagtgggaaggacaggacactgccaacttctcatgaccccaacagtctgcagtgggcatgagacattctgggatcagtgctgcagaatcctagacaaggatgagcatggagggatagtgcctgcctccctgcatagctcagacagcacagctcagacagcacagctcagacggcagagctgacagagatccaccctgctccccaggacacccggccagataccacagctactctgtggctcagaacccgagagggctcagaggccaacatggtgcttaccgggacagcatcctgtaggcgtcctgcttgtccaccggcttctccagaatcagccccccgactgtctgtgagaggaagggacagagggagttggttcccaccggctgggtcaggcctgtgcaagtcccacggtcccattcgcagaagtcacttgttttatggaaatgaagctgacacgtcctgagagtcgccatttcaaacaactaaccagagttgccatgttgtaccaccactacctgcctggttccaggatgttctcttcactccagaaggagaccctgtccccacgcagctgtccctccccagtgcgcctccccagatcctggtaaccgcccatcctctttctttcaccgtgcgtttgcctgttgcggacgtggtgtagtcatggaatcctgcaacgtgtggtcctccggggctggtttctgtcactgaccgtgatgtcctcaacattcatccatgttgcagcctgtttcacagcctcgttcctttccttttcttgagatggagtctcactctgtcgcccaggctggagtgcagtggcacggtcttggctcactgcaacctccgcctccggggttcaagtgattctcctgcctcagcctcccgagttgctgggaatacaggtgcacaccaccatgcctggctaatttttgttattttttatttatttattttttgagacagagtctcgctctatcacccaggctggagtgcagtggcgcgatctcggctcactgcaagctccgcctcccgggttcacgccattctcctgcctcagcctcccgagtagctgggactacaggcgcccgccaccacacccggctaattttttgtatttttagtagagacggggtttcaccatgttggccaggatggtctcgatctcctgaccttgtgatccacccgcctcggcctcccaaagtgctgggatgacaggggtgagccaccgcacccggccagcctcattcctgttcatggctgcataatattccactgtgtgtggatggaccatgttgtaatttcccatttacccactgacagacacttgagctgtttctgccttttagctgttgtgaatagtgctgctgtgaacattcatgtagaaggttttggtggaacacctgttttgaatccttttgggtacatacaagagtagatgtattagtctgactgggccaccatagcaaagtcctacaacccaggtggcttaaactacagacattgattctcccatcgtcgtggagactggaagggcgagatccaggtgtgggcagggctggttcctcctgaagcctctctcctgggcttggagatgccatcttctccctgtgtcctcacagactcgtccctctgtatctgtgtcctcatctcctcttcttatgagatgctttagtccatctcaggctgctgtcacagaataccacagactgggtggcttataaacaacaggcagtgattctcccacagccctggaggctggaggtctgagatccaggtgtgggcagggctggttcctcctgaggcctctctcctaggcttgtagacgccgtcttctccctgtgtcctcacagggtcatccctctgtgtgtgtctgtgtccttatctgctcttcttatgaggtgtcttagtccatttcaggctgctaaaacaatactatagactgggtggcttataaacagcagacattgattcttccataatcctggagtctggaagtctgagatccaggtgtgggcagggctggttcctcctgaggcctctctcctgggcttggagacgccgtcttccccctgtgtcctcacagggtcgtccctctgtgtgtgtctgtgtcctcatctcctcttcttatgagatgtcttagtccatttcaggctgctatcacagaataccatagactgggtggcttatgaacaaaagacatgggccgggcgtggtggctcacgcctgtaatcctagcactttgggatgccgaggcgggtggatcacaaggtcaggagatcgagaccatcctggccaacatggtgaaaccccgtctctactaaaaatacaaaaaattagccacacgtggtcgcgcgcacctgtagtccccgctactcgggaggctgaggcaggagaatcattgaaacccgggaggcggaggttgcaatgagctgagatcatgccactacagtccagcctggcgacagagtgagactccatctcaaaaaaaaaaaaaaggagaaatgggtctttgcctaggtaattaagatgcggttggacagaattaggatgcgcattttatgagtggtgttgttaaaagaaggggaaaatttcagccgggcgcggtggctcacgcctgtcatcccagcactgtgggaggctaaggtgggcagatcacttgaggtcgggagtttgagaccagcctggccaacatggtgaaaccccgtctctactaaaaatacaaaaatcagccgggcgtggtggcgggtgcctgtgatcccagctactcaggaggcaggagaatcgcttgaacccgggaggcggaggtcccggtgagccgagatcacgccactgtaatccagcctgggcaacacagtgagactctctctcaaaaaaaaaaaagaagagggaaatttggccacagacacccagaggggagaaggccacatggagatggaggcacagataggaaccacagggccatgagccaaaggagacaatgggttgccaacagcctctaggagctggagaaagaccaagaccaacttctcctcagtacctctggaaggaagaaaccctacagacaccgtgatttgtggttgctggcctctagaactgcgtaccttcctgtgccttttgagacggagtctcgctcttgtcacccaggctggagtgcagtggcgcgatctcggctcactgcaaccccgcctcctgggttcgagcgattcccctgcctcagcctcccgagtagctgcgattacaggcggagtctgtattctgtatcattgatgatatagaattaatgtagcttatctgttactatgtgttataatattctcttgcaattgatatcatatagtatcacttatgatactatcaattagccaccacgtctggctaatttttgtatttttagtagagatggggttttaccgtgttggtcgggctgatctcgaacccatgacctaaggtgatccgcccacctcggcctcccaaaatgctgggatgacaggggtgagccacggcgcctggccccttcccgtgcccttaggcccctcatctgctggtagtttgtgatgggagtttctggaagcgagtccactgctgtcttaaggggaatgtacaacatccacaagaggcagaatcaccaagcacaggaaaaccacatcggacattagaaacgaggcaccctggccgcactcaccacgatcgtgtccgctccaatgaccacgtcgggggcccgcaggtctttctgtaagaaaaccagattccggtttaccggtgacgtgccgtgggtctcacagagaagttttcccgtcggtacgggcgtgaaagagcaccgcaggggcgaagccaggccgactttggaagtgaaggctgggggtgctcaaggtcacgagcaaggacacaagtgggtcccgccggtggtcgccctgcaggggctggaacgtgggtgaggccggggcccacgggggctgcgtgatcaggggtcaggcactcacggagcatctcacgggcactacgggaaacgcaatgcctgttccgtaagcttttgttcttccgggcggcaggtaaggtttgattcaggggccccaaacctccctgagttacccagaattaaggccaaaaggtttttgatccgttcaatgtaatttcagaaaaagctacttagggctgggcgcggtggctcacgcctgtcatcccagcactctgggaggccgaggcgggcgcatctcctgaggtcaggagttcgagaccagcctggccaacatggtgaaaccccgtctctactaaaaatacaaaatatcagtcgggcacctgtaatctcagctactcaggaggctgaggcagcagaatcgcttgaacctaggaggcggaggttgcagtgagccaaggttgcgcacctgcactccagcctgggtgacagagtgagactcagtctccaaaaaaaaaaagaaaaaaaaaaacaaggaaaagaaagaaaaagaaaaaggtacttaggacgataaaacaaatccaggttgaaaattcagcctcagagcaacaggcagtcacaggacatctgtgtgcagctttgaccttagctcagccccgcactggcctccctaagctgtgcactgccaaaacccacaatcaatactcctgtcttgatagcacgactcacaacagccttacctctaatgtatttctttctttctttttttttttttttgagatggagtctcgctctgtcgcccaggctggagggcagtggcgcgacctcggctcactgcaagctccgcctcccgggttcacgccattctcccgcctcagcctcccgagtagctgggactacaggcgcccgccaccgcgcccagccaatattttgtgtgtgtttttagtacagacggggtttcaccgtgtgagccaggatggtcttgaactcctgacctcgtgatccgcccgcctcggcctcccaaagtgctgggatgacaggtgtgagccactgcacccggccccgaatgtatttcttatattaacagtaatggtatattgtgtggtaacacacagcagcagggaagctacattaactctatatcctaaatgatagcattatattcattgtaacagcaagttaaaacacacagtaatagctatgttaattttatatactgtgactgacattatgttagagtcatatataacatatagtaattgataagctacattaattgtacatcctaaatgacagtagtgtattaattataatagtgtattacggtggggtgcggtggctcacgcctgtaatcccaacactccgggaggccgaggcgggtggatcacctgaggtcaggagttggagaccagcctggccaacatggtgaagccccatctctactaaaataatatgtattacataggagcatatagtaacagataaatgacataattctacattatgatacaattatattaattgtcatagtatattacatagtatcacacagtaacatattaattctatgtatcacaacacatagtaatggatgttaattctatatcgtaactgatattactatattaattgcaatattatattcaaacatagtaacaagctacatgaatcttaaatcttaaatgatagtagtatattaattataattgtatattgcattgtagcatacagcaacagataaactgcataattctatattataaatgatattattttaattaaaatccgatattacttagtggcatggtaataagctacataattctatatcataaatgatactattatattaattgcaagagaatattataacacatagtaatagataagctacattaattgtatatcatcaacgagactattatattgattgcaagataatttttgttttaattttttattttttggagacgaagtcttgctctgttgcctaagttggagtgcagtgggatgatctcggctcactgcaacttccgtctcccaggttcacgcaattctcctgcctcagcctcctgagtagctgggattacaggcacccgccaccacgcccagctaatttttgtatgtttagtagagacggggtttcaccctgttggtcaggctggtctcgaattcctgacctcaggtgatctgtccgccttggcctcccaaagtgctaggattataggtatgagccaccgcgaccggccacaagagattataatacatagtaatagataagctacattaattctatatcataaatgatactatgaaatcaattgcaagagaatattataacacatagtaacagataatctacattaattctatatcataaatgatactgtgatatcaattgtgacaatattataacacatagtaatagataagctacattaattctgtatcatcaatgatactatgatatcaattgcaagaggatattataacacatagtaatagataagctacattaattgtatatcataaatgatactgtatcaattgcgagaaattattataacacatagtaacagataagctacattaattgtatatcatcaatgatactgtatcaattgcaagagaatattataacacacagtaacagataagctccattaattctgtatcattaatggtattattaggttactgcaatagtgcattacattataacatagcaatagctaagctgtgccaccaactgcatcttttgaatgacgtttatttgtgtcatgtatatttaccacccgcaaatcccctcatcacagcaaaggaattttcataagggccgaagggcaggggccccttgcctggtacagccggttggccacctccagggccttctgcttggcggtctccatggcgtacccatacggagtagcgaaggaggctttgtccagcttctctttaaacttggaggggaccacctcaaacctgagaccctgcaacagtagaaaaggggtcagaagggtcaatgaaagaccctatgaaaagtgaatgggacatgcaagatttgcaggacgcacatagcgtttgctacactccccgaccctgtcccaggtgagctcatccatccgccaagctttccctaagtgtggctggggagccggggactgaccagggctttccctaagtgtggttagtgggccgcggactgaccaggggccttcagggactgaccaggggccttcttggctctcgagggaagagattggcaaaggaagaagccaggaacaaagaggccagcagggaggtattgactcgggccttgaacccacgagccaacagtgtccgaggattcccagagacctgaaggttggggcagagtacaaaacccaacctgcccacaggaaattcaggaaaaacgccagcaatgatggctgtgggaagggagacaatgatggctctacgtcaatccctggtacccaggaagagacaacaccgcccctggggaggcctggcctagaggtagtgacccctgcagagaccgtggggtcaggaatgatggtggtaaatgcctccagtgggggagcccctggctgccacaccctgccagggtgcagggaactccgcatctcccctctgaccatctcccctctgacagagcaaaagcatcgccatcttggacacacaccgccatcttggagagacaccaccatcttggacgcataccaccatcgtggacacacaccgtcgtcgtggacacacactgccatctgggacacacaccgtcgtcgtggacacacaccgccgtcgtggacacacgccgccatcttggacacacaccgccatcgtggacacacaccgccatcgtggacacacactgccatctgggacacacaccgtcgtcgtgcacacacaccgccgtcgtggacacacgccgccgtcttggacacacaccgccatcatggacacacaccgccatcttggacacacaccgccatcttggacacacaccgccatcttggacagacaccgccatcttggacacacaccaccatcatggacacacgccgccatcttggacacacgccgccatcttggacacacaccgccatcttggacagacaccgccatcttggacacacaccaccatcgtggacacatgccgccatcttggccatcatggacacagtgtcattgtggacacacaccgccatcttggacagacacctccatcttggacacacaccgccatcatggacacacaccgccatcttggacagacaccgccatcgtggacagacaccgccatcgtggacagacaccgccatcatggacacacaccgccatcatggacacacaccgccatcgtggacacacactgccatcttggccatcgtggacacacacccccatcgtggacagacatcatcgtggacacacactgccatcttggccatcgtggacacacacccccatcgtggacagacaccatcgtggacacacaccgccattttggccatcgaggacacacaccaccatcgtggacagacaccgccgtcgtggacagacacccccatcatggacacacaccgccatcttggacagacacccccgtcttggacagacactgccatgttggacacacacttccattttaagttcccttgattaaaaactgcctaaatccagcccccaaacatcagcctaatggctaatgtcagcatgaccagaaacattccagccgtgggataaacccctctgtgaccagaaacctcccctccgaccagagacagtccaaccccgcaatcaattttccctcacacagaaacattccgagcctgcgagaagcccccttttccaaaaccctttgctgagccactttttgtatttttttttttttttttgaaacggagtctcgctgtgtcgcccaggctggaggggcagtgatgccatctcggctcactgcaagctccatctcccaggatcaagcgattctcctgcctcagtctcccgagtagctgggattgcaggtgggcgccaccacacccggctaatttttgtatttttaatagagatggggtttcaccatgttggtcaggctggtgtcgaactcctgacctcaggtgatccgcccgcctcggcctcccaaagtgctgggattacagatgtgagcctctgcgcccaggctcactttctatatttgtttcctccttcttaaactcttacatttggtgccgaaacccaggacaggtgttacggacagaggcccttttgcaacccaggatgcagtgggcaggggcagcctgtcccgggctaactcctggatcctttagagcctctggccctctgaccctgtcctttctctctctccctctttgagtgttgggagtggaggttctcttgcaacccaggaagctgtgggcagcagcagctcatcctgggctaactcctggatcgtgagggtctctggccacccctcccatcttttctctccattcaccttccaagcaatttgtgtgaggaagacaactcatgtaaaggggacttagaggctcaagctggagggttctcaaaaccctcaggtctcagaaatccacctctgaccccctgcaacaggtatttcgctccctaacccttgcttcgtcttcctctctcttcgtccgtcttcttccctcttctctctctctctctgtcttccctgcgcggctccagtttgggagcccctttgccaattccaacaggaacatccaacatcagacacaaatccagccgtctggtaagatctgccctcctctgacttttggtacccaggaaaagtcaggtcggccatcccagtcctcggaggaccagcggcactaagctagaagcgatcttgagggatgcccagtatcttctcagcttggccgtcctccttataaagaggattctgggtctctgtcttttgtctggggttgcctaaaacacaaacagacactctcggcttccttttaccagcccacgtgggtgccaaacaacccgacattcctatgtcctcctctctgggatgtctcctttccaacctggccaaacttggcttacagaggaacctaaagccagagtgttgaattttttattgcaatagtctggcatcaatacaaactacataatgacagcagatggcccgaacatagcacctttaacttgcaaattctcagggaccttgacaactttatcaccaggaaatggcaagaggttccctatactcaggctatcttctaccctccctatgtcaagttgcacctctcattgtgggcggcaagacacccaggtgctgaggcaagagaccgaggacacgagctcttccggtatatgataaaatataaaacgagaaagttataccagatatagatcttagatatggttatatatgaatatcattaatcattagttggtagtaattactctttataccaatcttataataatccttgctctagaatcataatgtaggaaaagccaggccatacagagataggagctgaggggacatggtgaggtgcgaccagaagacgagcgcgagccttctgttatgcccagacggggtcaccaaagggagtctccctttccctgggggggtttagagaagactctgctcctccacctcctgtggaggacctgacatcagtcagacccgcccgcagttatccggaggcctaaccctctccctgtggtgctttgcttcagtggtcacacgctcctagtccgccttcatgttccatcctgtacacctggctctgcctttagttagcaggagcaaattagtgaaagtactaaaagtgtctgataagcagaaataatggcgtaagctgtttctctccttctcctctctctctctgcctcggcggccaggcagggaagggccccctgtccagtggacacgtgactcacgtgaccttacctatcattggagatggctcacactccttaccctgctcctttgtcttgtatccaataaatatcagcgcagcctggcattcgggaccaccaccagtctccgcgtcttggtggtagtggtcccccgggcccagctgccttttcttttatctctttgtcttgtgtctttatttctacactctcatgcctccgcacacagggagagatccactgaccctgtggggctggtccctacatctcatgacatttttttttttttttttgagacggagtcttgctctgtcgcccaggctggagtgcagtggtgccatctcggttcactgcaacctctgcctcccaggttcaagcgattctcctgcctcagcctcccaagtagctgggactgcaggcgcccgccaccacgcccggctaattttttgtaattttagtagagacggggtttcaccatgttagccaggatggtctcgatctcctgacctcgtgatccgccaacctcggcctcccaaactgctgggattacaggcatgagccaccatgcccagcccataatttgtcttttaataaaagtgggaaaactggaaaaagaaaaatcgtgtttgaaaaactatagttacccctgtcgtgaaattctagtcttgcctaatggttttcagtttttattcttttctacggtttgaattaaattctaatttttctggctacatgtctccaagataatgttttgcattcttttcctttttctttttctccaatttttcctaactgaaaacctctgaaacccaagttctgctttcttaaagccctgtgaactaaaagctagatgtttcaacgggtgctgcttggaaggcccctaaagagtgctaccaggaacaaatcaacctcttcccctccagggctgtgtttggtgacccgtaataaccacctccctcagcaggaagtggccagaaagaacacaccacccctcgtcctgttataactagagggtctggattcacagagcaggagcattgccatcttcgacacacactgccatcttggacccattacaccatcttggacacacaccgccatcttggataagcaccaccatcttggacacacaacatcttggacacacatggccatcttggagaagcaccaccatcttggacacacactgccatcttggataagcaccaccatcttggacacacaccatcttggacacacacggccatgttggagaagcaccaccatcttggacacacaccgccatctgggagaagcaccaccatcttggacacacaccatcttggacacacacggccatcttggataagcaccaccatcttggagacacaccatcttggacacacaccgccatcttggataagcaccaccatcttggagacacaccatcttggacacacaccgccatcttggagaagcaccaccatcttggacacacaccatcttggacaagcactgccatcttggacatgcatggccatctttgacacacaccaccatcttggacacacaccgccatcttggataagcaccaccatcttggacacacacagctatcttggataagcactaccatcttggacacacaccatctgggacacacactgccatcttggacccataacaccatcttggacaagcaccgccatcttggacacaccgccatcttggatacacaacaccatcttggaaaagcaccaccatcttggacacacaccgccatcttggataagaaccaccatcttggacacacaccatcttggacacacaccgccatcttggataagaaccaccatcttggacacacaccatcttggacacacacagccatcttggataagcaccaccatcttggacacacaccatcttggacacacaccgccatcttggataagcaccaccatcttggacacacaccgccatcttggataagcaccaccatcttggacacacaccatcttggacacacactgccatcttggataagcaccaccatcttggacacacaacatcttggacacacaccgccatcttggataagcaccaccatcttggacacacaccatctgggacacacactgccatcttggacccataacaccatcttggacaagcaccaccatcttggacacaccgccatcttggacacgccaccatcttggatacacaccaccatcttggaaaagcaccaccatcttggacacacaacatcttggacacacactgccatcttggataagcaccaccatcttggacacatgccgccatcttggacacacactgccatcttggataagcaccaccatcttggacacacaccatcttggacacacacggccatcttggataagcaccaccatcttggacacacaccgccatcttggataagcaccaccatcttggagacacaccatcttggacacacactgccatcttggagaagcaccaccatcttggacacacaccatctgggacacacaccaccatcttggataagcaccaccatcttggacacacaccgccatcttggataagcaccaccatcttggacaagcactgccatcttggacatgcatggtcatctttgacacacaccaccatcttggacacacaccgccatcttggacaagcattgccattttaagttcccgtgattaaaaactgcctaaaaccagccccaaaacatcagcctaatggctaatgtcagcatgaccagaaacagtcaaagcctgaaataaaccgcctctgaccagaaacatcccaagcccaagataacctccttcagaccagagacattctaacacctcagtcaactttgcctcacagggaaacattccgagcctgcgataagattccccttcctaaacccttaaatacccttagtctgtaagagagaacactcctgacctaactcagccagaagccccgctcaggcttgttctccaaaataaacccgtctttgactgtgaagctgcttttcttttttcgtctttcttccactcttctacactcctcagcgctcctcacctcttgaaggtgcccccagatcctggccctgacgcccatcctggtcttcagggcaccagtcaccaagccctggacctgccctgcagatctcaaccccagatcatatagacccctgccctatgccctgtcacccccaatcatggagacccatgccttctgtgaggcaccctgaccactctcatccccgtcactaggaccaggcatgtggtgtcccccctcccagggtaccagacctccagtccgtagtccccaagagtagactcctgccccactgcaccatccataggcaaccagtaactaccctaccatcaccagtaacttctctgccatcaccagtaactacctcacatcaccagtaactaccccccatcaccagtaactatgccccatcatcaaacccagtaactaccccccatcaccagtaactatccaccatcaccagtaactatcccccatcaccagtaactatgccccatcatcaccagtaactatccccccatcaccagtaactatctcccatcaacagtaactatcctcccatcaccagtaactatccccacatcaccagtaactacccccatcaccaataactatgccccatcatcaaacccagtaactatcccaccatcaccagtaactaacccccaccaccagtaaatatgccccatcatcaccagtaactatccctcatcaccggtaactacgccccatcaccagtaactatctcccatcaccagtaactatcccccatcaccagtaactatccttccatcaccagtaactatgcccccatcaccagtaactatcccatcaccagtaactatcaccccattaccagtaactatcccacatcacctataactatccgcctgtcaccagtaactaccccccatcacaagtaactatcccttcatcactagaccgtctcctccatgtgattagggctccagagagaggcagacacccactacctaggcgtcctaccacccggaataagatcctcatgggggcaccaggaaacacttcccataccccagctacaaagtccaaccatcagtcacagggcccactccatccctagaagtcctgagtcactcacctccccaatccctaggggtcccaggtcactcccctcccccacccctagggggtcccgggttactctcccctcccccattcctaggggtcttggattactctcccctcccttatccctaggaggtcctggatcacactcccctcccccatcactagggcatcctgggtcactctcccctcccccatccctaggggctctgggtcactctcccctcccccatccctaggggttctgggtcactctcccctcccccatccctaggggttctgggtcactctcccctcccccatccctagggggttccgggtcacactccccaaccccatccctaggggttctgggttactctcccctcccccatccctagggttcccgggttactctcccctcccccaaccctaggggtcccaggttactttccccacccacatccctaggcggtactggatcactctcccctcccccatccctaggggtcccgggtcactctgccctcccccatccctatgggtcccgggtcactctgccctccccattcctagggggtcctggctcactctcccctcccccatccctaggggtcctgggttattctcccctcccccatccctaggggtcccgggtcactctgctttctccattcctagggggtcctgggtcactctcccctcccccatacctagggattccggatcactctcccctcccccatccctaggcggtcctggatcactctcccctccccattcctagggggtcctgggacactcctccctccccatccctagggggtcctgggacactcctccctccccatccctaagggggtcccaggtcactctccccaaccccatgcctagggcgtcctgggttactctccccacccccatccctagggggtcctgggttactctccccttccccatccctaggtggtcctgggtcactctcccctccccattccttgggggtcccgggtcacccttccctcccccatccctagggggtcctgggtcactctccccaaccccatgcctaggggttccaggtcactctcccctccctcatccttttgggtcccgggttactctccctacccccatccctagggggatcccggcttactctcccctcccccatccctagggggtcccaggttactctcccatccccattcctagggggttctgggtcactccctgcaaccccatgcctaggggtttcgggtcactctccccacccccatccctaggggggtcccgggtcacttgacctccccattcctaggggtcccgggttactctcctctcccccatccctaggggtcccgggttactctccccacccccatccctaggggggtctcggcttactctccctatccccaaccctggaggtcccgggttactctccccatccccatgcctgggggtcccgggttactctccccatccccatccatggggctccggggtcactctgctgtccccatccctagcggtcctgggtcactcctccctccccatccctagggggtcccgggtcactctccccaaccacatgcctagggcgtcctgggttactctccccacccccatcgctagggggtcccaggttacaggttactctctccaaccccatccctaaggtgtcccgggtttctctcccctcccccacccctaggggggtcccgggttactctcccctcccccatccctagggggtcctgggtcactctccccaaccccatccctaggggtcccgggttattctccccaaccccattcctgggggtctcggcttactctccccatccccatgcctgggggtcccgggttactctcctctcccccatccctaggggtcccgggttactcccccacccccatccctagggggggtctcggcttactctccccatccccaaccctggaggtcccgggttactctccccatccccatgcctgggggtcccgggttactctcctcatccccatccatggggctccggggtcactctgctgtccccatccctagcggtcctgggtcactctaccctccccattcctaggggtcccgggttacgatcccctcccccatccctatggggacccaggtcactccccacccccatgcctagggggttccgggttactctcccctcccccatccctagaggttccgggtcactctccccaaccctatccctggaggtcccgggacactctcccctcccccatccctaagggtctcgggtcactctcccatccctatccctagagttcctgagtcgctgggccctccggggttcagcccctccgtccccggtcccctgccccgcccaggcccaggccgtaccgcgttgctgaggatctcctgacggcgtggggaggcgctggccagcaccacgcgcttgtgcagcagcttcccaatcaccgggcacagcaccatggcgtccacgccgggagccgggcgtccgcacttctgagcccggagcccgcggtgcgcgcagcgcggctgcaaaaaaaacaggcggccagagtcccgcctccgcgaggccacgcccccgcccgcctccgcgaggccacgcccagtccgcgccttcagtggcctccccgcgagaccgcgcccaggccacgcctccattgaacactccgtcaggcctcgcccaggccacacctccattgccctctccaccaggccacgcccatgtcacgccccattgatctcccctgagaccacgcccagaccacgcctccattgccctctccgtcaggccacgcccaggccacacctccattgccctctccgccaggccacgcccatgtcacgccgccattgaccgctccgccaggccacgcccaggccacacctccttgccctctccgccaggccacgcccatgccacgccgccattgagctccccgtgaggccacgcccaggccacacccccgcccgcctcccccccgggcaccgccccggccgcttggtgaagcaccgcccccagctccgcctcccgggccccgtccccgcccccggcgctcgccccgcccctccccaccccgcctgcggcgccaagacctgcaatggcgcaggcagctgcggggtcccggggaggaaaggctggcgtggatacttggggttccttgcaggcgcggcgtggggagtggaaatgctgggtttccgcagctgcggttgtgggcagttgtgggggtggggggttcttacccgcacgtggaggggcccggcgcagagatgggggtcttgtgggagccgcgtcggggaaggtagagatagggggttccccgcggacccggtgcgagtggcgtggggatggggatgtcctcgtgcctggtgggaggggagtggagat

SEQ ID NO: 189 - DNA, 49840 bp, Homo sapiens
acaggcttttgctttctttattcagtcacgactacacgctcctatgtgactgtcctatggtacttggggaccgggcggtccacctgcagcctgggggaggacatccctataatgaacatgctgcctgggcttcagggggccactttggtggccaagatggcatccaggacaccccccaagtgcaccacctgcacctggtggaagccgtgcagctccagcaagcactgatactcgcccaggctccgctccttgccttcagtctgcaccagcatgttcagtgactgcatcagggcgcgctgcgccaccctcttctcctcatccaggagcgtctccaccagcagcaggccggcccctgagggagacagcagagagctggagtcctggccagccaggcggggatccttcagcaggacacaggggacacagcaggcaacaggagctcagaacggtgagcagaggctgctgagaacccttggccagggggcccacacaggtaggggaggggagagagacagagacttgatgcagggcggacagacagggagaaggagatttgatcgaaagatggatggatagatggatgcatcacctgggccttttccggttctcctggatgcatggatgaacagatggtagatgatgggtgggtaggtaggtagaaagatgtatggataggtggacgcatggatgagaaggatggatggatgaacagatggtaagtgatggggaggtacatggatggatggatagatggatgcatgtatgagatggatggatgggtgaatagatggtagatgatgggtaggtaggtagatgagtggatggacagatggatgcatggatgtgatggatggatgggtgaatagatggtacatgatgggcaggtagacggatggatagatggatgcatggacgagatggatggatgggtgaatagatggtacatgatgggtaggtaggaagatgaatagatgggtgcatggatgagatggatggttgggtgaatagatggtagatgatgggtacgtaggtagatggatggatagatggatgcatggatgagatggatgggtgaatagatggtagatgatgggtaggtaggtagatgaatggatggatagatggatgcatggatgagatggatggatggatgggtgaatagatggtagatcatgggtacatagatagatgaatggatggatagatgaatgcatggatgagatggatgggtgaatagatggtagatgatgggtaggtaggtggatggatggatggatggatgcaggcatggatgagatggatggatgggtgaatagatgggtaggtaggtagatagatggatgtatagatggatggatggatgggtgaatagatagtagatgatggttaggtaagtaggtagatgaatggatggatagatggatgcatgcatgagatggatggatgggtgtatagatgatagatgatgggtaggtaggtagacgaatggacggatagatggatgcatggatgagatggatggatgggtgaatagatggtagatgatgggtaggtagatgaatggatggacagatggatgcatggatgagatggatggatgggtgaatagatggtacatgatggacaggtagatagatgaatggatggatatatggatgtatggatgagatggatggatgggtgaatagatggtagctgatggataggtaggaagatgaatagttggatgcatggatgagatggatggttgggtgaatagatggtagctgatgggtacgtaggtagatgtatggatggatagatggatgcatggatgagagggatggatgggtgaatagatggtagatgatgggtaggtagatgagtggatggatagatggatgaatggatgaatagatggtagatgatgggtacgtagatagatgaatggatggatagatggatgcatggatgagatggatggatgagtgaacagatggtagattatgcgtaggtaggtagatgaatagatgggtgcatggatgagatggatggttgggtgaatagatggtagatgatgggtacgtagatagatgaatggatggatagatggatggatgggtgaacagatggtagatgatgggtacgtagatagatgagtggatggatagatggatgtgatggatgggtgaatagatggtagatgatggatcgttaggtggatggatagatggaggcatggatgagatggatggatgggtgaataggtaggtaggtagatagatggatgtatagatggatgcatggatgtgatggatggatgggtgaatagatagtagatgatggttaggtaggtagatgagtggatagatagatggatgcatgcatgagatggatgggtgtatagatgatgggtaggtaggtagacggatggatggatagatggatgcatgcatgagatggatggatgggtgaatagatggtagatgatgggtaggtagatagatgaatggatggatagatggatgcatggatgagatggatggatgggtgaatagatggtacatgatgggcaggtagatagatgaatggatggatatatggatgtatggatgagatggatggatgggtgaatagatggtagatgatgggtaggtaggaagatgaatagatggatgcatggatgagatggatggttgggtgaatagatggtagctgatgggtacataggtagatggatggatggatagatggatgcatggatgagatggatgggtgaatagatggtagatgatgggtaggtagatgagtggatggatggatgaatggatgagtagatggtagatgatgggtacgtagatagatgaatggatggatagatggatgtatggatgtgatggatgggtgaatagatggtagacgatgggtaggtaggtggatggatagatggaggcatggatgagatggatggatgggtgaataaatgggtaggtaggtaggtagatggatgtatagatggatgcatggatgagatggatggatggctgaatagatggtagatgatgggtagatagatgaatggatggatgagatggatggatgggtgaatagatggtagatgatgggtaggtaggaagatgaatagatgggtgcatggatgagatggatggttgggtgaatagatggtagatgatgggtaggtaggtagatggatggatggattcatggatgagatggatggataggtgaatagatggtagatgatgggtaggtaggtagatgaatggatggatagatggatgcatggatgagatggatggagggatgggtgaatagatggtagatgatgggtacgtagatagatgagtggatggatagatggatgtatggatgtgatggatgcttgaatagatggtagatgatgggtaggtaggtggatggatggatggatagatggcatggatgagatggatgtatgggtgaatagataggtaggtaggtagatggatgcatggatgtgatggatggatgggtgaatagatagtagatgatggttaagtaggtagatgaatggatggatagatggatgcatgcatgagatggatggattagtgaatagatggtagatgatgggtaggtaggtagatgaatggatagatacatggatgcatgcatgagatggatggatgggtgaatagataatagatgatgggtaggtagatgaatggatggatagatgggtgcatggaacagatggatggatgggtgaatagatggtagatgatgggtacatagatagatgaatagatggatgcatggatgagatggatgggtgaatagatagtagatgatgggtaggtagatgaatggatggatagatgcatggattggatggatgggtgaatagatggtagatgatgggtaggtagatggatggatggatggatgcatgcatggatgagatggatgggtgaactgatggtagatgatgggtagatggatggatggatgggtgaactgatggtagatgatgggtaggtagatagatgaatggatgtatatagatggatgcatggatgagatggatggctgggtgaatagatggtagatgatgggtaggtaggtagatggatggatggatagatggatgcatggatgagatggatggatggctgaatagatggtacatgatgggcaggtagatgaatggatggatagatggatgagatggatgggtgtattgatggtaggtgatgggcaggtaggtagatgaatggatggatatagatggatgcattcatgagatggatggatgggtgaatagatggtagatgataggtagatagatgaatagatggatagatggatgcatggatgagatggatggatgggtgaatatatggtagatgatgggtaggtagatgatggatggatggatagataataaatgatagacagatgacaggtgacggagcattgttagaaggccagacgcagtggctcacacctgtaatcgcagcactttgggaggcagaggtgggaggatggtttgagcccaggagtttgaaaccaacctgagcaacatagtgagaccctgtctctattttattttttttaaaaaaggatgatagatgtataaagagagacagagacagggtggagagagggaggaagagacagagaagataaaggaggaaggaggagagaagagaaacagagattgatgatgatagatgagatacctaaaaagacacagagaggaggagacagagaggaagagggagaagagagagaaagagagacagaggccgggtgcagtggctcatgtctttaaccccagcattttgggaggctgaggcaggaggatcgcttgagcccaggaagggtagcctgggcaacatcgcaagatcccatctctacaaaatttaaaaaaccctaacagggcatgataacaaatgctggtactcccaaatactcgggaggctgaggcaggaggatcgcttgagcgcaggaggtcaaggctgcagtgaactatgatggcaacactgccctccagccaaatgctggtactcccaaatactcgggaggctgaggcaggaggatcgcttgagtgcaggaggtcaaggctgcagtgaactatgatgacaacactgccctccagccaaatgctggtactcccaaatactcgggaggctgaggcaggaggatcgcttgagcccaggaggtcaaggctgcagtgaactatgatgacaacactgccctccagccaaatgctgctactcccaaatactcgggaggctgaggcaggaggatcgcttgagtgcaggaggtcaaggctgcagtgaactatgatgacaacactgcagtccagccaaatgctggtactcccaaatactcgggaggctgaggcaggaggatcgcttgagcccaggaggtcaaggctgcagtgaactatgatgacaacactgccctccagccaaatgctggtactcccaaatactcgggaggctgaggcaggaggatcgcttgagcccaggaggtcaaggctgcagtgaactatgatgacaacactgccctccagccaaatgctggtactcccaaatactcgggaggctgaggcaggaggatcgcttgagtgcaggaggtcaaggctgcagtgaactatgatggcaacactgccctccagccaaatgctgctactcccaaatactcgggaggctgaggcaggaggatcgcttgagcccaggaggtcaaggctgcagtgaactatgatgacaacactgccctccagccaaatgctgctactcccaaatactcgggaggctgaggcaggaggatcgcttgagtgcaggaggtcaaggctgcagtgaactatgatggcaacactgcactccagccaaatgctgctactcccaaatactcgggaggctgaggcaggaggatcgcttgagcccaggaggtcaaggctgcagtgaactatgatgacaacactgcagtccagccaaatgctggtactcccaaatactcgggaggctgaggcaggaggatcgcttgagcccaggaggtcaaggctgcagtgaactatgatgacaacactgccctccagccaaatgctggtactcccaaatactcgggaggctgaggcaggaggatcgcttgagcccaggaggtcaaggctgcagtgaactatgatgacaacactgccctccagccaaatgctggtactcccaaatactcgggaggctgaggcaggaggatcgcttgagtgcaggaggtcaaggctgcagtgaactatgatggcaacactgcactccagccaaatgctgctactcccaaatactcgggaggctgaggcaggaggatcgcttgagcccaggaggtcaaggctgcagtgaactatgatgacaacactgcactccagccaaatgctggtactcccaaatactcgggaggctgaggcaggaggatcgcttgagcccaggaggtcaaggctgcagtgaactatgatgacaacactgccctccagccaaatgctggtactcccaaatactcgggaggctgaggcaggaggatcgcttgagcccaggaggtcaaggctgcagtgaactatgatgacaacactgccctccagccaaatgctggtactcccaaatactcgggaggctgaggcaggaggatcgcttgagcccaggaggtcaaggctgcagtgaactatgatgacaacactgccctccagccaaatgctggtactcccaaatactcgggaggctgaggcaggaggatcgcttgagcccaggaggtcaaggctgcagtgaactatgatgacaacactgccctccagccaaatgctggtactcccaaatactcgggaggctgaggcaggaggatcgcttgagcccaggaggtcaaggctgcagtgaactatgatgacaacactgccctccagccaaatgctggtactcccaaatactcgggaggctgaggcaggaggatcgcttgagcccaggaggtcaaggctgcagtgaactatgatgacaacactgccctccagccaaatgctggtactcccaaatactcgggaggctgaggcaggaggatcgcttgagcccaggaggtcaaggctgcagtgaactatgatgacaacactgccctccagccaaatgctggtactcccaaatactcgggaggctgaggcaggaggatcgcttgagcccaggaggtcaaggctgcagtgaactatgatgacaacactgcactccagcctgggtgacagagggggactcctatctccacaaaaaacttttttttttttttctgagacggagtcttgctgtgttgcccaggctggagtgcagtggcgcgatctctgctcactgcaaccttcgcctcccaggttcaagtgatgtcctctctcagcctcctgagtagctagaattagaggcgtgcaccactacgccggactaatttttgtatttttagtagaggcggggtttcaccacgtggcttaggctggtctcgaactcctgacctcgagatctgcccgctttggcctcccaaagtgctgggattacaggtgtgagccaccgtgcccggtctcagaaaaaacttcttaaaaaattagctgggcatggtgatgcatgatgcatgcctgtacttccagctactcgggaggctgaggtgggaggacagcttgagcctaggaggtcaaggctgcagtgacctgtgactgctccactgcacaccagcctgggcagcagagtgagacctcgtctcaaaaaatataatagagccgggcgaggtggctcacgcctgtaatcccaacactttgggagtcccagctgggtggatcacccgaggttgggagttcgagaccagcctgaccaacatggagaaaccctgtctctattaaaaataaaaaattagccgggcgtggtggtatgtgccagtaatccagctactcgggaggctgaggcaggagaatcacttgaaccctgggggtggaggttacggagagccaagatcgtgccactgcactccagcctgggcgacagagcgagactccgtctcaaaaaaaaaaaagaagagagatacacagagaaagagagaaagaaggagagacagagggagagaagaatggaagtctcttgaccatttgagcctatggggagtcctgtttcaacgcgcaggtgccaggccctggctctgtgaagataattaaccgttgtctgcaaatattccaggaattctcactggagcaacaacgctgaactcttgagggaggctgagtgcccgtcagattccctcagggccagctggttcaactgtggaaacccaatatgcagccctggcccgaacccctggagccagggtttccagcagccccactgggctccaggagcagcctgggtggacgggggagaaacctgatgtgaaggctttgagccgagatggtgcgtgctgtgtgtgtgtgcacgtgtgtctgcgtagaaacacacagattagatccagctgcagagtccactcatgcgtggatttccctctgcctcggccacccctgagacagcaacaccagcccacggcttcctcctctgcagcctcctcagtgtgaagacctcctcaagaatgaagacttttatcatgagccacttcaacttcacgaatagtaaatatattttctctttaggattttcttttttttttttttttttttttttgagatggagtctcgctctgttacccaggctggagtgcggtggcgcagtctcggctcactgcaacctccgtctccaggttcaagcgattctcctgcctcagcctcctgagtagctgggattacaggcacccgctatcaagcccggcttattttttgtgtttgtttttaatagagacggggtttcaccatgttggccaggctggtctcaaacccccgacctcaggtgatccgcccgcctcggcctcccgaagtgcggggatgacaggcgtgagccaccacacctggccacactggccaactttaaatacagcagatttaccctccacaatttagcgggcctctcacccagacgctggacctgccaacctccaaagtcacataagccaattctttttttgttgtggttgttcttttttgacaccgaatctcactccgtcgcccaggctggagtgcagtggcgcgatctcggctcactgcagtctccagctcccgggttcaagtgattctcctgcctcagcctctgaagtacctgggattacaggtgcgcactaccacacctggctaatttttgtatttttagtagagacggggtttcaccatgttggccaggctggtctcgaactgctcaccccgggtgatccacctgcctcagcctcccaaagtgctgggattataggcatgagccaccacgcctggctaatttttgtatttttagtagcgatggggtttcaccacgttggccaggctggtctgaaactcctgacctcaggtgatccgcccgcctcggcctcccaaagcgctgggatgacaggcgtgagccaccgcgcccggcctccttgtaaaacttgaacccaaaatactacgtcttaacaaaaacagctaacctgacgatgggctctcacctggcttgcagctctcggcgaccctgctgagtaacttgtggactttgtcgtctggccagtcatgcaggatccggcacaggacgtacagctcagcgctggggagggggtccctgaaaaagtcacctggtttaaagacaaaacgagatacgtccgtcaggtatggaagaagcagtcctccccggacagatcctgggacggccacccgcatcctaaatcagggacagagaagagaggggtgtgggcgggaatgggtcttcctgaagtacatccccgtggggacttgaacagagctccatgaggagctggttagtgatgtcacgcccgtgcggtttgactcgggctgagaaaacgctggggacagtggctcacacctgtaatctcagcattttgggagcctgaggtgggcagattgtctgagctcaggagttcgagaccagcctgggcaacacggcgaaaccccatctctactaaaaatgcaaattagctggacaggggtggcgggcgcctgtcatcccagctacgcgggaggctgaggcaggagaatcgcttgaacctgggaggtggaggttgcagtgagccgagatcgcgccatcgcactccagcctgggcgacaagaaggcaagggaggaaaaaagcagggaattcaggggcagcacctgggcgaggcaggcagagtcggcgcacatgggcgtgtgccagggagagtcggggccgcactgccggtgagtgggcaatggcagggccttctctggtgatcccctgattcaggcgccccaggagggttgcctgttgcggggggcgcatgtagctgcacgcccctctgtaattgctgaaataaaaagatggtctgctgtagtgcagtgaatggtgtccccttaaaagatatattcaggtgctgaccctcagtcgctgggaatgggaccttatctggaaatagggtctctatggatgtcattgagtaaagaatttcaaaatgagatcatcctggagtagggtgtcccctaaatccaatgacaggtgtccttctaagagacagaagaggagacagacacagaggagaaggccacgtggagacggaggcagagactggagtgatgcggccacaagcccagggacgcctggagcccccaggagctggaagaggcgggaaggatcctcccctagagcctctcagaaagaatcaaacacaactgcaatgggttgggtggtgacgtccaaaagatctgtccaagtcctaagccccagaacctgggaatgggacctcatttggataaagtttctttgcagatgtaattaaggatctggagatgggatcatcctggagtagggtgggccctaaatgcaatggcaggtgtccttctaagagacagaagaggagacacacagaggagaaggccacgtggagatggaggcagagactggagtgatgcggctacaagcccagggacacccggagcccccaggagctgggagaggcaggaaggatcctcccctagagcctccagagggagcacagccctgagatgccttgatctcagacctccggtctgcaggacagggagaggataaatagcaagctgtgagttgcatgaggggaaagaaggggcgggagagtgtgcggtgggaagtctccagagctgttttcccccagctgcgaggagaaggtgctctttcagggctcatgattttaaactttagcatttccggccgggcggggtgtaatcccagcactttgggaggccaagacgggtggatgacctgaggtgaggagttcgagaccagcctggccaacatggtgaaaccccatctgtactaaaaatacaaaagttagccaggcgtggtggcgggcacttgtcaccccagctactcgggaggctgaggtgggaggatcccttgaacccaggaagtggaggttgcagtgagctaagatcacgccactgcactccagcctgggtgacagagcgagacaccattcaaacataaataaatttcagcatttctgtctctgcagatctggcaaatcagaagcacagctatcatgatgtcctgcaggaggagctgtagggtggttgcgttttgtttttttaaaaacgagaaaagcatccaggaacctctgggggagggttgtggaggtccccagcacctgtgcccacaggcctggccgctgtcggatggtgctgagttacagcacgtcagctgtctctttttttatttttttattttttttgagatggagttttgctgtgttgcccaggctggagtgcagtggcgcgatctcggctcacggcaagctccgcctcccgggttcaagcgattctcctgcctcagcctcctgaataggtgggattataggcacccgccaccatgcctggctaatttctgtaattttagtagagatggggtttcaccatgttgctctggctggtctcaaactcctgacctcaggtgatccacccgcctcagcctcccagagggctgggattccaggcgtctcctgtcaatccgtcctggcctcagcagctgccacctggaagttctccttcaagtctaacctaaggccacactgtgacggctctcgggtcagttccttccgtgacctcggcaccgtggatgcccatgaatgctgatctcggctgttccccatctccactcccctcacgtctcggctacttgcactgatgataacttcacacagtcgtccacctgtttatttttatttatcattattattatcattgtctttttttttttgagatggagtttcgctcttgttgcccaggctggagtgcagtggtgagatctcagctcactgcaacctccgcctcccaggttcaagcgattttcctgcctcagcctcctgagtagctgggattacaggcgcccgccaccacgcccggctaatttttgtatttttagtagagatggggtttcgccatgttggccaggctggtctcgaactcctgaccacaggggatccgcccgcctcagcctcccagagtgctgggattacaggcgtgagctactgtgcccagccttgtccacctgtttggagatgccctcgtgtctgtgtggacccgcagagagacacgcacaggcagacccacggacgcacagacacagacacaggcacacacacatatacccatccagatgcacagaaatgcagacacaaaggcacacatgcaagcacacgccacaagacatgcacacacggacacatgcaggacacagatacactgacaggtacacacatggacacacagatacagcaagacaggcacacacacacacacggacacagatacagtgacaggcacacgcgcacagagacagacatgcacagatgggcacactcacgcacggacacacagtgatacaccaacaggcacacacagacgcagacatgcacagatgggcacacacacatggacatacagatatagcgacaggcacacacagacgcagacatgcacagcaacaggcacacacagacgcagacatgcacagatgggcacagacagacacgcacggacacacagatacaccaacagacaggcacgcacacagacgcagacatgcacagctggacacacacacacacggacatacagatacagtgacaggcacacacagacgcagacatgcacagatgggcacacacacacacggacatacagatacaccaacagacaggcacacgcacataaacatagacatgcacagatggacacgcagacacacatggacatacagatacagcgacaggcacacacacacggatgcagacatgcacagatgggcacacgcacggacacacagagataccccaacaggcacacagacgcagacacacagacatacacacatatacccacacagacgcacagaaacacacataccctcacacatatgcaagcacacaccacagagagttgcacacacacaaacgcagatgcagacacagagacacattcttacgcacgcacacacaaggacataccacacacagtcagtcatgcacacacagacacatgcacacacagacgtacacacaagcacagcagtgacatgcacacacaccatgcacacagatacagatgggcacacagacatgcacacacagacatgtacacatatatccacagacacgcagacacacataccctcagagacatacacaccacagaggtgcacacacacacacggactcagacacagagacattctgacgtacagacacgcatgcaaggacataccacacagagatgtgcacacacagactcagaaacacacagagacacagacacaagcacagcagatgctcacatatccacacagacacacaccatgcacatagatgcagacacacagacaagcacacccagacacatgcacacagacacacaaccacagcagtcacatatgcacacaaccaccggcccacagcatgcacacagatgcagacgtacacacagacacatgcacacagggacacacaaccacagcagtcacatacacacacacacctaccagcacacagcatacacacaaatgcagacacagacgggcacacagacgcacatacacagacatgcacacatatatccacacggatgcacacacatcacctcacagaaacatatgcaaccacacaccacagagacttgcagacacgtggacacacagtctcatgcacagacacacacacaaggacatactacacagacgtgcacacacagttacatatgcacggaagacacacaccatgcacacagatacagacacagacatgcacacacacacacatgcacacagacacacaagcacgacagtcatatgcacacagacacccaccggctcacagcatgcacacagatgcagacacacacacacagacatgcacacatatacccacacagacacacacacatactctcacagaaacatatgcaaccacacaccagagacgtgcacacacatgcggatgcagacacacacacacacagacatgctcacgcacagacatgctccatgtcacaggtatgctccagggcataccacacacatgcacacagagagacacacacacacaagcaccgtagacagtcccatttgcacacacatacccaccatggaaacgcccaggcagaaacacaggtgcacacacagccatgccctctgtctagaaagagatgctgcagtctggaaaaggttagcagggtgaacaggaggagggctcacctgctgcgaagtggatctgcactgcctgcggtccggggggttggaagtgggcggccagctcgataatgtctgggaggtcaaacacagtcacctgcatacgagggtactcacgggccagctctcgggccagtgcacccgtgcagcctgcggggaagcaaatgcatgctctgtggctgggtcgtctatggaactctgacgactctccaaagctcaactggggcagaagtaatgttcaagggcatggcattgattcccatgctggaagggaaagccagtggtggggagctcgctggtatcccagacaagactgtacaagcaggtgagtgtgggggcacagacctgcagggaaatccttccagcccaggggtggagggctgtactcccttctccttcctgccgtggggatgtagacacaatggccggtgctacagcagccactctgggccacgtgtagggggcacagacctacagggaaatcctttctgcccaggggtgggggctgtactcctcccttctccttcctgccatggggatgcagacacgatggctggtgctacagcagccactctggaccacaaggaggagaggcattcagaggttggggaaatgtaagctgatggtgtgagaatcgtcccaggccccgatcccccagcagcccttgggaatgtgtctactgctccacccactgtccagggctggggtggggtggagggtgagtcaggatataatcagacttgctgaggggaatccaggggttccaaggtgctctgcctcagctccgcagccaaaagagagggccccggagtttctaggggggcatttaggcatccccggggtcctcctggaacttgggaatatccacccatgatctgggactcagcctggcccggttcaggtcgttatcaggtttgtcaatggaaaaaggcagttggtaggtgtcctgagcagggaagatacctgtggcttaataaacgaaagtaaggagagccctggcgggggggccacccacctcccacgtcgcaggcggaggagaagcgggacagattgaaggccgtggccacctggcacgcagtcagcttcgtcatgccgtgcatggcccgcatgaacctcagccgcgtctccgggctctggtagtacgcatcctggaacacagcaggtgcttaggggcaccagagaacacggggcgagggctcgcccagcctctccctgggggtcggggggagaagtgcagggctccagagcgtgggggctcagccgcgcctgggctgcagagcgggcttcatgccacagctgtgtgggctactcttgtctgtgtgggggctgggctggctggggacagaggaccccaaagtggtggacgatctccttggaatcacttggtccacaccacagcctgaactccaagcgtctgactttcgcagtaggcttttcacaataaagcttttcaccctggaggctccgggtggcccacaaacacctcactggagaaaaccaggagagaagccacaatgtctctgcaggtgccccggctcagccttcaccacaatggtgcggtgtgcagagggggctcctccgagaattctggtgtgcagaggagaagctcctccgagcttctccaagtccccccagtggcacctaccccgggtcccagaggagcccaggctcatcctggctcagtgctgtgtccagggttcgcctggacatcccgtccctgcagggcaagcaagcccagctgaggatgcttctgagccccgctcccagcaggacagccggtctccatcctggctccctaaatctcgcgggggctccccggccctcccctgcgtgggtggcaatcatggggctcagggatctgtcctctgcgatgcccacgctggctgctcacgccagctcagggcccctgtccgtgcctctcggcttctccaccactggcttctctctctgactctttctcccttggtctctgtctgtctgtctctgtctccgtctgtgtgtctctgtcttcctctttctctctctctgtttctgtctcctgtctctgtttctttctatctccctctgtctctgtctctatgtctgtctcctgtttctgtctctatctgcctctatctctgtctctccaagcctccctgtctctgtctcccatctccctctatgtgtctgtctgtctccatctttgtttctgtctccctatctctgtctccgcctccctctgtctctcaagtctccctgtctctccatctctctccctatctcactatctgtctcccatctccgtgtctgtctcactctatctctgtctctgtctttctgtctccctgtttctgtctccctctatctccctgtctctgtctgcctccatctctgtctgtctctgtctccctctatctttctgtctgcctatctctctctctgtgtctccctgtctgtatgtctctccccaacatctgcaggaagcccccggctccctggggctcatctctgcatcacacacacacaccctgactccgtgctcactgccacagaagctcggccagcgctgccaaggaggcatgaggccacggccagccgagcccacagcagactccccacgcctggctggcacagccctgcagaccgagacccacccatctgcacaggccccacggaccccaccatatctcacacgtccacctcaggaaggttctgggcggggaaaggggaaggaggggcgagaggatgcagggagcgctttgcaaacagcggcctcagataagcaagtgtcagttccattgaagcaaagaagaaacagggcattcatttaaggcagcctgtccaactccttcctatttctatttttcagacagagtcttgttctgtcacccgggctggagtgcagcagcaccatcacggcttacactgcagccttgacctcccaggttcaagtgatcttcccacccacctgggcctcccaaagtagctgcctaatcatacctggctaatcgttaatttttttttttttttttgagatggagtttcgctctgtcacccaggctggagggcagtggcgtgatctcagctcactgcaaccaccacatcccgggttcaagtgattctcctgcctcagcctcttgagtagctgggactacaggcacgcgccatcatccccagctaattttttttttgtatttttagtagagatggggtttcagcacgttggccaggttggtctcgcactcctgacctcaggtgatcagcccaccttggcctcccaaactagctgggattacaggctcatgccaccatgcccagcctaactgttaattttttgtagagatgggggtctcactatgttgcccaggctggtctcaaactcccgggctcaaatcatcctcccaacttggcctcccaaagtgctgggagtgacaggtgtgagcccctgagcatggccttcaaacctgtttctaggaggaaattctattttcatcagctgctggataacagtggaggatgtctaagttgcacctgttccagggctgagtgacacaagagccacggcactaagttctccaggcagaacgagccaagcctttgggatctgtcagactggagacagactggtcaaggtgcctactgatctgtgtgtcaaagtgttttagcaaaatgcacgctagacggaaaggtgtccgcgggggtgttatgctacctggaacagatcttccgccttcttccccaacgccctgtggtgctggtttgttccctctcggatggcaaactccaggtatgtaaagaggttccatgtgaggtcattattgtgcatgatgaagccgtgcagagagtattcgccatccgatgccaggtagacgttcgctgtctctgtgttactgtaacctggagaaatggggacagtcgtgtgacctcctaacgagaaaacccaaggaaacctgaccgtaggggatgtatcattgagatgttaaaataaacatcacccatctgactatagcaaaccgtacactcaaggaaacctgaccataggggatgcatcattgagatgttaaaataaacatcatccatctgactatagcaaactgtacactcagggtcagctgggcaggaaaacagcagccaccacgccccagctgtcaactgctgtaactgttacccactgaggctgatcctttcttcatgatcgtggccacgctcaagttcccagttatgcaggcaaacacccatctagatgtggctgtggaggtgtgctgtagctggcgtttgcatctaccatcagtttgactttaaggagattaaccccccaaaatgtgcattggcctcatccagctcattgaaaaccccagaagcaaacattgggctttcctggaggagaaattccacttgaagatggcagcagcagctcctgcctgagcttccagcctcctggcctgccctgtggattttggacttgccagcctacacaatcacgtaagtcctcaagataaatctcctaggttatatcctaggggttctgttaccctggagagccccaaatgatacagggaacttcattctccacccacttcatgcccaggtcagctgtccatagacccagtccccaagctcccttccaggatgccccctcccacagaatgggaggctggaaggtggagaagttgttggtggagacccgtatatggaaacagatggcctcgcaccactccggtcctcctatgtaagaaacagccctgtgttcatgttaatgatgaaatgttactgttttcccaccgagctgaccctgagtgtacggtttgctatagtcagatagatgacatttattttcatcatgaataaatgatgagacctatggtgaagcaggagcagcctctgcagacgtggaactgctcctaggactcaactgcacaaagcgttgtcaaaaggagttggaacaagcttgcatggtgccggtgatgaaaagcctttctccatattcatcattattttctttcttttaattttttaattttttttgagatggagtctcactctgtcccccaggctggagtgcagtggcacgatctcagctcactgcaagctccgtctcctgggttcatgccattgtcctccctcagcctcccgagtagctgggactacaggcacccgccaccgtgcccggctaattttttgtatttttagtagagacggggtttcaccgtgttagccaggatggtcttgatctcctgaactcgtgatctgcctgccttggcctccccaagtgctgggattacaggcgtggcctattcatcattattttcaatacgggagaatggtcctgaactgctctggctggggaagatgttctggcttctatgttccagcctctaaggatatagtcacatgtctctgtggtaagggcacagcctttggagcctcaaccagggcatgctttgtctcctaatcacagaagcacagccacctctgcccaggtgtcatctgttgtcctgcccttcccaggctactcaaggacttggtcatgtgctctctattctagcaccatgctgaagagttctgttcaattcagaaaacacattgtcatccatccatccatccacccactcacccacccatccagttatccactcacccacccatctagtcatccacccacccatctgctgatccacccattcatcactcatctatgcattcccccacccatccaatccaccgatccacccatctacccactcatccatccattcccccacccagctacccatccagcaatccactgatacatctatccatccatcctcccatccatccgtccacccacccatccatctattcacccaccctcccaatcatccacccagccatgcacccatccatccactcatccatccattcacacgcccacccatccacatgcccactcatccatccatccacctacccatccatctattcacccatccactgatggatccactgatccatgcacccatgcatgcatccatacatccacatccatttatccattcattcccccacccatccaatcactcatccatccatctgtccatccatccatccatccacccacccacctacccatccatccacccatccactgatggatccactgatccatccacccatgcatgcatccatccatccacatccatttatccattcattcccccacccatccaatcactcatccatccatccatccacccacccacccacccatctgttcacccaccctccccatcatccacccagccatgcacccgtccatccattcatgcactcatccacatgcccactcatccatccacccatccaaccacccacctacccattcatccatccattcccccacccagctacccaaccaccgatccactgatatatctgttcatccaccctcccatccatctgtccacccacccatccgtctattcacccacactcccaatcatccacccagccgtgcacccatccatccactcatccatccattcacacgcccacccatccacacgcccactcatccatctatccacacatctatccactcacccatccatccacacatccatccatccatccatctgtccgtccatccatccatccagccacccatccactcacccacttatccatccacccatccatccacttacccacccatctatgcactcatccaccgattcatcgatccatccatccatctacccacctttatccatccagtcatccacccatccatccacacatccttccattcacacatccatccatctatccactcacccactcatccatccacccatccatccacttacccacccatctacccacccttccatttatccatccacctctccatccatccatctatccatccacccacccacccatccatccacccatccactgatccaccaatccatccaccttcccatccatgtatctatccatccattgatcaatccatctgtccatccatccatccatccatccctcctcccatccatctatccacctaccatccatccatccatccatccatccttcctcccatctatccacctaccatccatccatccatctatccatccatccatttatatatcaactctacccatcatctatgtatctgtcatctctctatcgtcaatctatatcaatgtatctatgcatttatcatctatctatgtatctgtctacccatccatctacgttatttgtctataaaaataaataagcaactaaatcaatgtctgtgtacaccgtattgggttctgtttctcaggagaacatggactgatacagcccctttgagactagagcccataaggaggtcacgcttctcctatgtgctcgcggctgccactgttccctctctgtcattcaccctctgcttctcaacctttcgggaaaagcagcattcctgagggcagagggacagaaggtgtgggcctccttcctcgctctgcccaggctccaggtcaccttccctcagtgacttccacctgcaaagatcctcagagcaaaacccgctgggtcctgtcaccttgctctgtcttctccaggagccccatggcagcacagatgtccagaagcctctccattccacacgcagaggcgtccactttgctggcaatatccgcagccttctggggtgcttcatcttttaacaaatcgaacaccttcagtttgcaagcggtgagcaggccctgttaaaagcaagtgcagagagactcattaagtcccttgtccagtactttctactcccacagactcaaaagatggaggccaacgctgtcggaagtatacaacttggccattgagccttctttcacagagaacggtggggatttataggatcaagtccccagctataaaacaaggtgtacacaaggaaaaagcacatcaacgaatatcatgcagaaaaactagcccatgggagaaaaatcaacatgctgccgatatggactgagttcaaaacccagatgttgaactcctaatccccccagtccctcaggatgtgactgtatttgtaggcagggttttaaagaagtgattcaggtaaaatgaggtcatttgggtggaccctaatccaataggactggggtccctataagaaaaggagatgaggacacagacacacacacagggacgaccctgtgaggacacagggagaagacagcatctccaagcccaggagagaggcctcaggaggaaccagccctgcccacacgttgatcttggacctccagcctccaggactgtgggagaatcaatgtctgttgtttataaaccacctggtggtgatttaataatcaccacttggtaaattagaggcacagacggaatgtgctgtaaccacctttattccttattcactgcatgttctctctcctgatgatgaatggcaggaggtgtcatcagcccgtctccctgtctcccaaagcctgcgtccctcctgcacccgacatccccacctctgcttcccggaggacgccctgtgagggacccctggtgttgggagggctgcatcccttctaggctgccaccgtgaggggcccctgaacagaacagctgaaagatggggcctcaggccgggcgcgctggctcacgcctgtaatcccagcactttaggaggccgaggcgggtggatcagctgaggtcaggagttcgagaccatcctggccaacatagcgaaaccctgtctctactaaaagtacaaaaattagccgggcttggtggtgggcgcctgtaatcaggaggctactcctgaggctactcaggatctcctcttgagattcttaattacatctgctaagacccctttttaaaacaaggtcccattcacagattctggggatcaggctatgaacagatctttcaggaggaccacagttaggaggctgaggcaggagaatcgcttgaacccgggaggcagaggttgcagtgagccgagatcatgccactgcactccagcctggatgacagagccagactctgtctcaaaaacaaaaacaaaaacaaaaaaaagagaaaaagaaaaaagggtctttgcagacgtaagtaagctaggggacttcagatgagttggagtcagtggattagggagacctcaaaatccaatgacaggtgtccttctaagagacagaagagacacagacacagaggagaaggccacgtggagacaaaggcagagactggagtgatacggccacaagcccagggatgcctggagcccccaggagctgggagaggcaggaaggaccctcccctggggcctccagaaggaactggatacatctgtagtggactgaactgtggtcctcctgaaagatctgtccatatcctgatccccagaatctgtgaatgggaccttgttttaaaaaggggtcttggcagatgtaattaagaatctcaagaggaaatcatcacgaagaagggtggactccaagtccaatgacaggtgtccttctaagagacagaggaggagacacagacacagtggatgaggccacgtggaggacgtggcagagactggagtgatgcggccacaagcccagggatgcctggagctgtcaggagctgggagaggcaggaaggaccctctcctagaaccttcggagaaagcatggccctgagacaacctgacctcagactgccagcctccaggacagtgagaagtaaattccctttgatttaagccgagtgtgtaggctcatttgtgaaatgtggcctgaggagacagacacaggtaccttggatagcataaagccctcaatcagctccaggaggcgtgtcgggaacggaggcagggtctcccgagtcctgtgacactcagcctctgccgtggcctgtcccgcctctcccgcctcggccttctcatcgcggctgcccgcgtccctctgagtgggctccgagccgcccccctccacgtcactgaggtcttcgaaggtgtccgcggccgggatggagtcgtgcttgacactccgccgcaggtcctccggacggggcgggtagtagagcttcaccagctgcttgcagaagtggttcagcgggaatcccaccacgttcagaaagtccccgtgtacggactccaccagcatgccgcccagggcctggatcccgtagccgccagctttgtccctgggtgggcaggggaaggtaagaggtgacaaggaggagaaaagttcctgggtctgaacatttcacggctgggaggcggaggtgggtggatcacgaggtcgggagatcgaggccatcctggctaacacagtgaaaccctgtctctactaaaaaaaatacaaaaaattagccaggcgtgggggcaggcgcctttggcatctcaaaaaaaaaaaaaaaaagaaaaacaatttcacagcaaggctgggcgcaatggctcacggctgtaatcccagcactttgggaggccgagacgggtggattacttgaggtcagaagttcaagaccagcctggccaacacggtgaaaccccatctctactaaaaatacaaaaattagccgggtgtggtgtggtggcacacgcctgtaatcccagctacccaggaggctgagacaggagaatcacttgaacccaggaggaggaggttgcagtgagccgagatcgtgccactgcactccagcctgggcggcagaggaagactccgtctcaaataaataaataaataaataaaatttcatgtgttaaatgggatgttttgacatatgtatacatgcgtcatcattaaatcaagccaattatcccattcagcatctcatctacgaattgtgtgtgtgtgtgtggggagaagacttcagatctagtgtgctggcaatttaccagtaagacactgttcctataaaccacagtcacaggctgtaaagagccttgaacttcttcctcctgtctcacttttttattttttatttttattttttaaagacagagtctcgctctgtcgcccaggctggagtgcagtggcgcgatctcggctccctgcaacctccgcctcctgggttcaagcgattctcctgcctcagcctcccgggtagctgggatgacaggcacctgccaacacacccggctaatttttgtatttagtagagacggggtttcaccatgttggccacgatggtctcgaactcctgacctcaggtgatgcgcctgcctcggccccccaaagtgctgggattacaggtgtgaaccaccacgtctggccctcttttctctttcttattttatctatttttttttttcaagacagggtctcactcggttgctcaggctgaagtgcagtggtacattcttggttctctgctccctcaaaattctgggctcaaatgatgctgtaatctcagcctcccacgtagcagggacacactcagctagttttatcattttttataaagatggggtttcactctgttgcccaggctggtctcgaactcctgggatgaagtgatcctcccgtcttggcttgagctactgtgcccggcctgtctttctttaaatgtatgtaaacattaaagtatgtatgaaagtgcaggtgttgggctgggcgcggtggctcccagcacttcgggaggctgaggcaggcagatcacctgaggtcaggagttcgagaccagcctggccaacatggcaaaaccccttctctactaaaaataaaaaattcgccaggcgtggcggtgggtgcctgtagtcccagctacttgggaagctgaggcaggagaatcgtttgaaactggaaggtggaggttgcagtgagccaagatcgcgccactgcactccagcctgggtgacggaggaagactccgtctcaaaaaaaatttcatgtgttaaatgggatgttttgatatatgtatacatgtgacatcattaaatcaagccaattatcccatcgagcacctcatgtacctattctgtgtgtgtggggagaagacttcagatgtagtgtgctggcaattttccagtaagacactgttcctgtaaaccacagtcactaggctgtaaagagccttgaacttctcccgtctcacttaattttttttttttaaaagacggagtctcgctctgttgcccaggctggagtgcagtggcgcgatctcggctcactgcaacctccacctgctgggttcaagcgattctcctgtctcagcctcctgggtagctgggattacaggcacctgccaccacaccgggctaatttttgtatttttagtagagattgggatttgccatatccaggctggtcttgaacttctgacctcaggtgatccgcctgcctcggcctcccaaagtattgggatgacaggcgtgagccaccatgcctggccctgatttaaatcttgtatcctttgaccaagtgcaactgttttatattccatataagtgagatcctgtggtatgtgtcttcttctgccgggcttatttcaattgatgtaaaatcctctaggttaatatacatatatattacgcagactccatctctacaaaaactaacaataaaatcggccgcgtgtgttggtgcgtgtcctgtggtcccacctactcaggaggctttggtggaaggatcgcctgagcccaggagttcaagaccagcctgggcaacatagtgagaccccattgctacaaaaaatagaaaaaattagccaggcgtggtggtatgcgtctgcagacccagccactagtggggctgaggtgagaggatcattttgactcaagaggctgacgctgcagtgagctatgactgtaccactgcactccagcctgggtgacagagtgagaccgtgtctcaaaaaaataaataaaattatttatataaatatataaaataaacatatattttatacaaatgtatttatatacatatatttatatatttatatacttttataatataaaaatatattttatataattatatatttatataacacataatacattatatattatatataactaatatgtattacatatatttaattaatatataatttacatataatcacactttatattattatgtaatatgtattaatatgcagttacatatattaatcatatttaatacatattacatattatccatatattcatatatttctatattatataaatatataattatattttataatatataatcattttataattatatatataattatatataatttatatttatataattgtttataattatatataattatatatcatttataattaattatatataattataaattatatttatatataattataaatatatgtaattatatatttatatataaataaaattaaatatataaaatatataaaattatatattttatatataattataaataattataaatataaattatataatttatatataattataatcgattataactacctattatataatctattttaacagttatataacctatcatataatctattataacagtatatattataatagatggtatatattacattaatattaatcactacttattaaaattaatcattaaaaatcattaaatttcaatcaaaagtgttaatatataatctatattataatatctatatgtaatatagtatacatattacagtataatctattatagtatataatacaatatattataaatatatattatataatttgtataatgtagattatatataattaatagaatatataatgtggaatacataaattatatataattgtaaatatatatcatgttacattatataatgtataattatgtagacattatatgacatatgatgtagataaatataatacatataaacgcaaatggtgggtgatgaagtgaagctgattggtgcacgcatacttcccgtgctcaccaatctgtggacgggacgacaggtagaatcacctcttagggtgactttggatcacagagtttattcgtgttaattgcagccagcgtcctgggcacagacctctggggtctcctcctcccaccacgtgaactcctctacccctgcccagcgcctccccagtccccaccgcagcccagcgttggctcccaccctgcccctctctgtcctgggagtttgcctctttgagcctccatgggtcagtgtggtcgtgaagggtttgtgcttctgagccgggcggctctccctgtgccacacggcccccggagcggggcctccttctttcccaaaggctgggtgggacaccccacgtgtgagggtggccaggcttccacacgtgtcccccgtccccccaccgcccccgagactcacatgggctccccgctgtggacgtattcccagagcagctcctcggacagctccgagaacttcaccttcgtttcctcgtagaattccgagaccctggtgtccagctgatggtctgcaaggacacagccgtgggggtgagcgtggacgccagcttgtcacctccgtgccctgacagctgcgtggctgtgctgtggaggtgtgtactcgagcgcagcgcacagttcagatatggatgcttcatgggagaataaggttcatttcggacaagaaaagggagaaaggggccgggcgcggtggctcacgcctgtcatcccagcaccttgggaggccgaggcgggtggatcacgaggtcaggagttcgagaccatcctggctaacacggtgaaaccccgtctctactaaaaatacaaaaaattagccaggcctggtagtaggtgcctgtagtcccagctactcgggaggctgaggcaggagaatcgcttgaacccgggaggtgcaggttgcagtgagccgagatcgcgcccctgcattccagcctgggccacagagcgagactccgtctctaaaaaaaacaaaagaaacagcagtttgggcggccgaggcggatggatcaccagaggccaggggttcgagaccagcctggccaacatggcgaaaccccgtctctactaaaaatacaaaaattagccgggcgtggtggcatgcacctgtcatcccagctactcgggaggctgaggcaggagaatcgcttgaacccgggaggcggaggttgcagtgagccaagatcacgccactgtactgcagcctgggcgacagagcgagactctgtctcaaataaataaataataaaagaaacagatgtttggtctgtgcctcagggtccggacacagagcccctgaatcccggggaatctgttgagtgacaggagcgaaagcaggcgttttgctatgtggtgacaagcccctttcatccgcaggggaccttatgttaatgaggggccttttggaaagggcaggctttggttgtcatgggaacagggggagggggctggagatggagtttgctccccagtggcggatgatgtcgttaatcctggccttttaagagacccagaagggaccgcgcgcggtggctcacgcctgtcatcccagcactttgggaggccgaggcgggcggatcacaaggtcaggagatcgagaccctcctggctaccacggtgaaaccccgtctctactaaaaaaaaaaaaaaaaaaaaaatagaaaaaattagccgggcgtggtggcgggcccgtcgtcccagctactcgggaggctgaggcaggagaagggcgtgaacccgggaggcggagcttgcagtgagccgagatggcgcaagtgcactctagcctgggcgataaagcgagactctgtcacaaaaaagaaaaaaaaaagagacccagaaggacagggttcagggagcttctggtgggtgaacacatcagggtgttggcagagctgtgccacggcgggcatggaggctccatacatcctgcacccagcaccctgcgctgtgcctggcttctgtctggcacttcctgacctgctccttcataacaaaaccccaagctgggaaggaaagtgctgtcccgagttctgtgagcccctcgagcaaatgacccaacctgagcaggtgcttgcaggagccagcagtgagcggcaggtgggtgagaaaactacaggtgtgaccagggatatggggctgggattgtgcgtggaggtcccatgggacccggcccttcacctgtgggatctgcgctaactccgacggctactgtcagaactgactgaattctacgatgcctcctggtgtccgccaacaagctgggaatgggttggtgcaggaagaacccagcaatatggtgatacaactgcctgggccgggcaccgtggtgcacacctgcagtcccagcaatatggtgaacacctgcagtcccagcactttgggaggctgagatgggaggatttcttcagcccaggagttcgagaccagtctgggcaacatagcaagaccgcacctctataaaaaatacaaaaatgagccaggtgtggtggcgtgtgcctgtagtttctgtgactgtaggggctgaggcgggaggatcgctggagctcaggaggtcgaggctgcagtgagctatgatcacaccactgcactccagcctgggtgacagagggagaccctgtctcaaaaaaaaaaaaaagaaagaaagaaagagaaaggccgggtgcagtagctcacacctgtaatcccagcactttgggaggctgaggcgggtggatcacctgaggtcaggagttcgagaccagcctggccaacatggtgaaaccccgtctctactaaaaatacaaaaattagccgggcatggtggtgggcacctgtaatcccagctactgaggcagaaggatcacttgaacttgggaggcggaggttgcagtgagctgagatcgtgccactgccctccagcctgggtaagagagcgagactccatctcaaaaaaaaaaaaaaaagaaagaaaaagaaaaagataaaaccacacgttttcctttgtcctgcagacttccaaatcggcggacaactttcccaagcaggacataggcacaaacccctccacaggtgggggtgagcaaccgtcctcctccctcaagccaagggtcccgagaatgtcccgggtccttgtctcggcctctggggctaccccgaaacctgggccgcggttacctttgctggagcagtggacgatcgcgacacctgtgaacacgctgtgttctctcccactcaacctgtaagacaacaacgggtgaccacgtgaccatgctgtgacccgtgggagctacaaagcgagtttctcaaaaccaggggaggcagcgaggcgtccttaatcctggatccgtccccagcatcttctccccgatcgtcccgctgtggggtctccagggaaacctttacggagaggccgagggaaggggtcacaaatcccaccagcagtggccctgacgggaggcgccaggccaggcagctctcagctgggcctatggcgggcagggggtgcatctcttccacgtcctgggatggggatgacgtcccaggctacgggctcaggtccaggatgcccagtgggaaggacaggacactgccaacttctcatgaccccaacagtctgcagtgggcatgagacattctgggatcagtgctgcagaatcctagacaaggatgagcatggagggatagtgcctgcctccctgcatagctcagacagcacagctcagacagcacagctcagacggcagagctgacagagatccaccctgctccccaggacacccggccagataccacagctactctgtggctcagaacccgagagggctcagaggccaacatggtgcttaccgggacagcatcctgtaggcgtcctgcttgtccaccggcttctccagaatcagccccccgactgtctgtgagaggaagggacagagggagttggttcccaccggctgggtcaggcctgtgcaagtcccacggtcccattcgcagaagtcacttgttttatggaaatgaagctgacacgtcctgagagtcgccatttcaaacaactaaccagagttgccatgttgtaccaccactacctgcctggttccaggatgttctcttcactccagaaggagaccctgtccccacgcagctgtccctccccagtgcgcctccccagatcctggtaaccgcccatcctctttctttcaccgtgcgtttgcctgttgcggacgtggtgtagtcatggaatcctgcaacgtgtggtcctccggggctggtttctgtcactgaccgtgatgtcctcaacattcatccatgttgcagcctgtttcacagcctcgttcctttccttttcttgagatggagtctcactctgtcgcccaggctggagtgcagtggcacggtcttggctcactgcaacctccgcctccggggttcaagtgattctcctgcctcagcctcccgagttgctgggaatacaggtgcacaccaccatgcctggctaatttttgttattttttatttatttattttttgagacagagtctcgctctatcacccaggctggagtgcagtggcgcgatctcggctcactgcaagctccgcctcccgggttcacgccattctcctgcctcagcctcccgagtagctgggactacaggcgcccgccaccacacccggctaattttttgtatttttagtagagacggggtttcaccatgttggccaggatggtctcgatctcctgaccttgtgatccacccgcctcggcctcccaaagtgctgggatgacaggggtgagccaccgcacccggccagcctcattcctgttcatggctgcataatattccactgtgtgtggatggaccatgttgtaatttcccatttacccactgacagacacttgagctgtttctgccttttagctgttgtgaatagtgctgctgtgaacattcatgtagaaggttttggtggaacacctgttttgaatccttttgggtacatacaagagtagatgtattagtctgactgggccaccatagcaaagtcctacaacccaggtggcttaaactacagacattgattctcccatcgtcgtggagactggaagggcgagatccaggtgtgggcagggctggttcctcctgaagcctctctcctgggcttggagatgccatcttctccctgtgtcctcacagactcgtccctctgtatctgtgtcctcatctcctcttcttatgagatgctttagtccatctcaggctgctgtcacagaataccacagactgggtggcttataaacaacaggcagtgattctcccacagccctggaggctggaggtctgagatccaggtgtgggcagggctggttcctcctgaggcctctctcctaggcttgtagacgccgtcttctccctgtgtcctcacagggtcatccctctgtgtgtgtctgtgtccttatctgctcttcttatgaggtgtcttagtccatttcaggctgctaaaacaatactatagactgggtggcttataaacagcagacattgattcttccataatcctggagtctggaagtctgagatccaggtgtgggcagggctggttcctcctgaggcctctctcctgggcttggagacgccgtcttccccctgtgtcctcacagggtcgtccctctgtgtgtgtctgtgtcctcatctcctcttcttatgagatgtcttagtccatttcaggctgctatcacagaataccatagactgggtggcttatgaacaaaagacatgggccgggcgtggtggctcacgcctgtaatcctagcactttgggatgccgaggcgggtggatcacaaggtcaggagatcgagaccatcctggccaacatggtgaaaccccgtctctactaaaaatacaaaaaattagccacacgtggtcgcgcgcacctgtagtccccgctactcgggaggctgaggcaggagaatcattgaaacccgggaggcggaggttgcaatgagctgagatcatgccactacagtccagcctggcgacagagtgagactccatctcaaaaaaaaaaaaaaggagaaatgggtctttgcctaggtaattaagatgcggttggacagaattaggatgcgcattttatgagtggtgttgttaaaagaaggggaaaatttcagccgggcgcggtggctcacgcctgtcatcccagcactgtgggaggctaaggtgggcagatcacttgaggtcgggagtttgagaccagcctggccaacatggtgaaaccccgtctctactaaaaatacaaaaatcagccgggcgtggtggcgggtgcctgtgatcccagctactcaggaggcaggagaatcgcttgaacccgggaggcggaggtcccggtgagccgagatcacgccactgtaatccagcctgggcaacacagtgagactctctctcaaaaaaaaaaaagaagagggaaatttggccacagacacccagaggggagaaggccacatggagatggaggcacagataggaaccacagggccatgagccaaaggagacaatgggttgccaacagcctctaggagctggagaaagaccaagaccaacttctcctcagtacctctggaaggaagaaaccctacagacaccgtgatttgtggttgctggcctctagaactgcgtaccttcctgtgccttttgagacggagtctcgctcttgtcacccaggctggagtgcagtggcgcgatctcggctcactgcaaccccgcctcctgggttcgagcgattcccctgcctcagcctcccgagtagctgcgattacaggcggagtctgtattctgtatcattgatgatatagaattaatgtagcttatctgttactatgtgttataatattctcttgcaattgatatcatatagtatcacttatgatactatcaattagccaccacgtctggctaatttttgtatttttagtagagatggggttttaccgtgttggtcgggctgatctcgaacccatgacctaaggtgatccgcccacctcggcctcccaaaatgctgggatgacaggggtgagccacggcgcctggccccttcccgtgcccttaggcccctcatctgctggtagtttgtgatgggagtttctggaagcgagtccactgctgtcttaaggggaatgtacaacatccacaagaggcagaatcaccaagcacaggaaaaccacatcggacattagaaacgaggcaccctggccgcactcaccacgatcgtgtccgctccaatgaccacgtcgggggcccgcaggtctttctgtaagaaaaccagattccggtttaccggtgacgtgccgtgggtctcacagagaagttttcccgtcggtacgggcgtgaaagagcaccgcaggggcgaagccaggccgactttggaagtgaaggctgggggtgctcaaggtcacgagcaaggacacaagtgggtcccgccggtggtcgccctgcaggggctggaacgtgggtgaggccggggcccacgggggctgcgtgatcaggggtcaggcactcacggagcatctcacgggcactacgggaaacgcaatgcctgttccgtaagcttttgttcttccgggcggcaggtaaggtttgattcaggggccccaaacctccctgagttacccagaattaaggccaaaaggtttttgatccgttcaatgtaatttcagaaaaagctacttagggctgggcgcggtggctcacgcctgtcatcccagcactctgggaggccgaggcgggcgcatctcctgaggtcaggagttcgagaccagcctggccaacatggtgaaaccccgtctctactaaaaatacaaaatatcagtcgggcacctgtaatctcagctactcaggaggctgaggcagcagaatcgcttgaacctaggaggcggaggttgcagtgagccaaggttgcgcacctgcactccagcctgggtgacagagtgagactcagtctccaaaaaaaaaaagaaaaaaaaaaacaaggaaaagaaagaaaaagaaaaaggtacttaggacgataaaacaaatccaggttgaaaattcagcctcagagcaacaggcagtcacaggacatctgtgtgcagctttgaccttagctcagccccgcactggcctccctaagctgtgcactgccaaaacccacaatcaatactcctgtcttgatagcacgactcacaacagccttacctctaatgtatttctttctttctttttttttttttttgagatggagtctcgctctgtcgcccaggctggagggcagtggcgcgacctcggctcactgcaagctccgcctcccgggttcacgccattctcccgcctcagcctcccgagtagctgggactacaggcgcccgccaccgcgcccagccaatattttgtgtgtgtttttagtacagacggggtttcaccgtgtgagccaggatggtcttgaactcctgacctcgtgatccgcccgcctcggcctcccaaagtgctgggatgacaggtgtgagccactgcacccggccccgaatgtatttcttatattaacagtaatggtatattgtgtggtaacacacagcagcagggaagctacattaactctatatcctaaatgatagcattatattcattgtaacagcaagttaaaacacacagtaatagctatgttaattttatatactgtgactgacattatgttagagtcatatataacatatagtaattgataagctacattaattgtacatcctaaatgacagtagtgtattaattataatagtgtattacggtggggtgcggtggctcacgcctgtaatcccaacactccgggaggccgaggcgggtggatcacctgaggtcaggagttggagaccagcctggccaacatggtgaagccccatctctactaaaataatatgtattacataggagcatatagtaacagataaatgacataattctacattatgatacaattatattaattgtcatagtatattacatagtatcacacagtaacatattaattctatgtatcacaacacatagtaatggatgttaattctatatcgtaactgatattactatattaattgcaatattatattcaaacatagtaacaagctacatgaatcttaaatcttaaatgatagtagtatattaattataattgtatattgcattgtagcatacagcaacagataaactgcataattctatattataaatgatattattttaattaaaatccgatattacttagtggcatggtaataagctacataattctatatcataaatgatactattatattaattgcaagagaatattataacacatagtaatagataagctacattaattgtatatcatcaacgagactattatattgattgcaagataatttttgttttaattttttattttttggagacgaagtcttgctctgttgcctaagttggagtgcagtgggatgatctcggctcactgcaacttccgtctcccaggttcacgcaattctcctgcctcagcctcctgagtagctgggattacaggcacccgccaccacgcccagctaatttttgtatgtttagtagagacggggtttcaccctgttggtcaggctggtctcgaattcctgacctcaggtgatctgtccgccttggcctcccaaagtgctaggattataggtatgagccaccgcgaccggccacaagagattataatacatagtaatagataagctacattaattctatatcataaatgatactatgaaatcaattgcaagagaatattataacacatagtaacagataatctacattaattctatatcataaatgatactgtgatatcaattgtgacaatattataacacatagtaatagataagctacattaattctgtatcatcaatgatactatgatatcaattgcaagaggatattataacacatagtaatagataagctacattaattgtatatcataaatgatactgtatcaattgcgagaaattattataacacatagtaacagataagctacattaattgtatatcatcaatgatactgtatcaattgcaagagaatattataacacacagtaacagataagctccattaattctgtatcattaatggtattattaggttactgcaatagtgcattacattataacatagcaatagctaagctgtgccaccaactgcatcttttgaatgacgtttatttgtgtcatgtatatttaccacccgcaaatcccctcatcacagcaaaggaattttcataagggccgaagggcaggggccccttgcctggtacagccggttggccacctccagggccttctgcttggcggtctccatggcgtacccatacggagtagcgaaggaggctttgtccagcttctctttaaacttggaggggaccacctcaaacctgagaccctgcaacagtagaaaaggggtcagaagggtcaatgaaagaccctatgaaaagtgaatgggacatgcaagatttgcaggacgcacatagcgtttgctacactccccgaccctgtcccaggtgagctcatccatccgccaagctttccctaagtgtggctggggagccggggactgaccagggctttccctaagtgtggttagtgggccgcggactgaccaggggccttcagggactgaccaggggccttcttggctctcgagggaagagattggcaaaggaagaagccaggaacaaagaggccagcagggaggtattgactcgggccttgaacccacgagccaacagtgtccgaggattcccagagacctgaaggttggggcagagtacaaaacccaacctgcccacaggaaattcaggaaaaacgccagcaatgatggctgtgggaagggagacaatgatggctctacgtcaatccctggtacccaggaagagacaacaccgcccctggggaggcctggcctagaggtagtgacccctgcagagaccgtggggtcaggaatgatggtggtaaatgcctccagtgggggagcccctggctgccacaccctgccagggtgcagggaactccgcatctcccctctgaccatctcccctctgacagagcaaaagcatcgccatcttggacacacaccgccatcttggagagacaccaccatcttggacgcataccaccatcgtggacacacaccgtcgtcgtggacacacactgccatctgggacacacaccgtcgtcgtggacacacaccgccgtcgtggacacacgccgccatcttggacacacaccgccatcgtggacacacaccgccatcgtggacacacactgccatctgggacacacaccgtcgtcgtgcacacacaccgccgtcgtggacacacgccgccgtcttggacacacaccgccatcatggacacacaccgccatcttggacacacaccgccatcttggacacacaccgccatcttggacagacaccgccatcttggacacacaccaccatcatggacacacgccgccatcttggacacacgccgccatcttggacacacaccgccatcttggacagacaccgccatcttggacacacaccaccatcgtggacacatgccgccatcttggccatcatggacacagtgtcattgtggacacacaccgccatcttggacagacacctccatcttggacacacaccgccatcatggacacacaccgccatcttggacagacaccgccatcgtggacagacaccgccatcgtggacagacaccgccatcatggacacacaccgccatcatggacacacaccgccatcgtggacacacactgccatcttggccatcgtggacacacacccccatcgtggacagacatcatcgtggacacacactgccatcttggccatcgtggacacacacccccatcgtggacagacaccatcgtggacacacaccgccattttggccatcgaggacacacaccaccatcgtggacagacaccgccgtcgtggacagacacccccatcatggacacacaccgccatcttggacagacacccccgtcttggacagacactgccatgttggacacacacttccattttaagttcccttgattaaaaactgcctaaatccagcccccaaacatcagcctaatggctaatgtcagcatgaccagaaacattccagccgtgggataaacccctctgtgaccagaaacctcccctccgaccagagacagtccaaccccgcaatcaattttccctcacacagaaacattccgagcctgcgagaagcccccttttccaaaaccctttgctgagccactttttgtatttttttttttttttttgaaacggagtctcgctgtgtcgcccaggctggaggggcagtgatgccatctcggctcactgcaagctccatctcccaggatcaagcgattctcctgcctcagtctcccgagtagctgggattgcaggtgggcgccaccacacccggctaatttttgtatttttaatagagatggggtttcaccatgttggtcaggctggtgtcgaactcctgacctcaggtgatccgcccgcctcggcctcccaaagtgctgggattacagatgtgagcctctgcgcccaggctcactttctatatttgtttcctccttcttaaactcttacatttggtgccgaaacccaggacaggtgttacggacagaggcccttttgcaacccaggatgcagtgggcaggggcagcctgtcccgggctaactcctggatcctttagagcctctggccctctgaccctgtcctttctctctctccctctttgagtgttgggagtggaggttctcttgcaacccaggaagctgtgggcagcagcagctcatcctgggctaactcctggatcgtgagggtctctggccacccctcccatcttttctctccattcaccttccaagcaatttgtgtgaggaagacaactcatgtaaaggggacttagaggctcaagctggagggttctcaaaaccctcaggtctcagaaatccacctctgaccccctgcaacaggtatttcgctccctaacccttgcttcgtcttcctctctcttcgtccgtcttcttccctcttctctctctctctctgtcttccctgcgcggctccagtttgggagcccctttgccaattccaacaggaacatccaacatcagacacaaatccagccgtctggtaagatctgccctcctctgacttttggtacccaggaaaagtcaggtcggccatcccagtcctcggaggaccagcggcactaagctagaagcgatcttgagggatgcccagtatcttctcagcttggccgtcctccttataaagaggattctgggtctctgtcttttgtctggggttgcctaaaacacaaacagacactctcggcttccttttaccagcccacgtgggtgccaaacaacccgacattcctatgtcctcctctctgggatgtctcctttccaacctggccaaacttggcttacagaggaacctaaagccagagtgttgaattttttattgcaatagtctggcatcaatacaaactacataatgacagcagatggcccgaacatagcacctttaacttgcaaattctcagggaccttgacaactttatcaccaggaaatggcaagaggttccctatactcaggctatcttctaccctccctatgtcaagttgcacctctcattgtgggcggcaagacacccaggtgctgaggcaagagaccgaggacacgagctcttccggtatatgataaaatataaaacgagaaagttataccagatatagatcttagatatggttatatatgaatatcattaatcattagttggtagtaattactctttataccaatcttataataatccttgctctagaatcataatgtaggaaaagccaggccatacagagataggagctgaggggacatggtgaggtgcgaccagaagacgagcgcgagccttctgttatgcccagacggggtcaccaaagggagtctccctttccctgggggggtttagagaagactctgctcctccacctcctgtggaggacctgacatcagtcagacccgcccgcagttatccggaggcctaaccctctccctgtggtgctttgcttcagtggtcacacgctcctagtccgccttcatgttccatcctgtacacctggctctgcctttagttagcaggagcaaattagtgaaagtactaaaagtgtctgataagcagaaataatggcgtaagctgtttctctccttctcctctctctctctgcctcggcggccaggcagggaagggccccctgtccagtggacacgtgactcacgtgaccttacctatcattggagatggctcacactccttaccctgctcctttgtcttgtatccaataaatatcagcgcagcctggcattcgggaccaccaccagtctccgcgtcttggtggtagtggtcccccgggcccagctgccttttcttttatctctttgtcttgtgtctttatttctacactctcatgcctccgcacacagggagagatccactgaccctgtggggctggtccctacatctcatgacatttttttttttttttttgagacggagtcttgctctgtcgcccaggctggagtgcagtggtgccatctcggttcactgcaacctctgcctcccaggttcaagcgattctcctgcctcagcctcccaagtagctgggactgcaggcgcccgccaccacgcccggctaattttttgtaattttagtagagacggggtttcaccatgttagccaggatggtctcgatctcctgacctcgtgatccgccaacctcggcctcccaaactgctgggattacaggcatgagccaccatgcccagcccataatttgtcttttaataaaagtgggaaaactggaaaaagaaaaatcgtgtttgaaaaactatagttacccctgtcgtgaaattctagtcttgcctaatggttttcagtttttattcttttctacggtttgaattaaattctaatttttctggctacatgtctccaagataatgttttgcattcttttcctttttctttttctccaatttttcctaactgaaaacctctgaaacccaagttctgctttcttaaagccctgtgaactaaaagctagatgtttcaacgggtgctgcttggaaggcccctaaagagtgctaccaggaacaaatcaacctcttcccctccagggctgtgtttggtgacccgtaataaccacctccctcagcaggaagtggccagaaagaacacaccacccctcgtcctgttataactagagggtctggattcacagagcaggagcattgccatcttcgacacacactgccatcttggacccattacaccatcttggacacacaccgccatcttggataagcaccaccatcttggacacacaacatcttggacacacatggccatcttggagaagcaccaccatcttggacacacactgccatcttggataagcaccaccatcttggacacacaccatcttggacacacacggccatgttggagaagcaccaccatcttggacacacaccgccatctgggagaagcaccaccatcttggacacacaccatcttggacacacacggccatcttggataagcaccaccatcttggagacacaccatcttggacacacaccgccatcttggataagcaccaccatcttggagacacaccatcttggacacacaccgccatcttggagaagcaccaccatcttggacacacaccatcttggacaagcactgccatcttggacatgcatggccatctttgacacacaccaccatcttggacacacaccgccatcttggataagcaccaccatcttggacacacacagctatcttggataagcactaccatcttggacacacaccatctgggacacacactgccatcttggacccataacaccatcttggacaagcaccgccatcttggacacaccgccatcttggatacacaacaccatcttggaaaagcaccaccatcttggacacacaccgccatcttggataagaaccaccatcttggacacacaccatcttggacacacaccgccatcttggataagaaccaccatcttggacacacaccatcttggacacacacagccatcttggataagcaccaccatcttggacacacaccatcttggacacacaccgccatcttggataagcaccaccatcttggacacacaccgccatcttggataagcaccaccatcttggacacacaccatcttggacacacactgccatcttggataagcaccaccatcttggacacacaacatcttggacacacaccgccatcttggataagcaccaccatcttggacacacaccatctgggacacacactgccatcttggacccataacaccatcttggacaagcaccaccatcttggacacaccgccatcttggacacgccaccatcttggatacacaccaccatcttggaaaagcaccaccatcttggacacacaacatcttggacacacactgccatcttggataagcaccaccatcttggacacatgccgccatcttggacacacactgccatcttggataagcaccaccatcttggacacacaccatcttggacacacacggccatcttggataagcaccaccatcttggacacacaccgccatcttggataagcaccaccatcttggagacacaccatcttggacacacactgccatcttggagaagcaccaccatcttggacacacaccatctgggacacacaccaccatcttggataagcaccaccatcttggacacacaccgccatcttggataagcaccaccatcttggacaagcactgccatcttggacatgcatggtcatctttgacacacaccaccatcttggacacacaccgccatcttggacaagcattgccattttaagttcccgtgattaaaaactgcctaaaaccagccccaaaacatcagcctaatggctaatgtcagcatgaccagaaacagtcaaagcctgaaataaaccgcctctgaccagaaacatcccaagcccaagataacctccttcagaccagagacattctaacacctcagtcaactttgcctcacagggaaacattccgagcctgcgataagattccccttcctaaacccttaaatacccttagtctgtaagagagaacactcctgacctaactcagccagaagccccgctcaggcttgttctccaaaataaacccgtctttgactgtgaagctgcttttcttttttcgtctttcttccactcttctacactcctcagcgctcctcacctcttgaaggtgcccccagatcctggccctgacgcccatcctggtcttcagggcaccagtcaccaagccctggacctgccctgcagatctcaaccccagatcatatagacccctgccctatgccctgtcacccccaatcatggagacccatgccttctgtgaggcaccctgaccactctcatccccgtcactaggaccaggcatgtggtgtcccccctcccagggtaccagacctccagtccgtagtccccaagagtagactcctgccccactgcaccatccataggcaaccagtaactaccctaccatcaccagtaacttctctgccatcaccagtaactacctcacatcaccagtaactaccccccatcaccagtaactatgccccatcatcaaacccagtaactaccccccatcaccagtaactatccaccatcaccagtaactatcccccatcaccagtaactatgccccatcatcaccagtaactatccccccatcaccagtaactatctcccatcaacagtaactatcctcccatcaccagtaactatccccacatcaccagtaactacccccatcaccaataactatgccccatcatcaaacccagtaactatcccaccatcaccagtaactaacccccaccaccagtaaatatgccccatcatcaccagtaactatccctcatcaccggtaactacgccccatcaccagtaactatctcccatcaccagtaactatcccccatcaccagtaactatccttccatcaccagtaactatgcccccatcaccagtaactatcccatcaccagtaactatcaccccattaccagtaactatcccacatcacctataactatccgcctgtcaccagtaactaccccccatcacaagtaactatcccttcatcactagaccgtctcctccatgtgattagggctccagagagaggcagacacccactacctaggcgtcctaccacccggaataagatcctcatgggggcaccaggaaacacttcccataccccagctacaaagtccaaccatcagtcacagggcccactccatccctagaagtcctgagtcactcacctccccaatccctaggggtcccaggtcactcccctcccccacccctagggggtcccgggttactctcccctcccccattcctaggggtcttggattactctcccctcccttatccctaggaggtcctggatcacactcccctcccccatcactagggcatcctgggtcactctcccctcccccatccctaggggctctgggtcactctcccctcccccatccctaggggttctgggtcactctcccctcccccatccctaggggttctgggtcactctcccctcccccatccctagggggttccgggtcacactccccaaccccatccctaggggttctgggttactctcccctcccccatccctagggttcccgggttactctcccctcccccaaccctaggggtcccaggttactttccccacccacatccctaggcggtactggatcactctcccctcccccatccctaggggtcccgggtcactctgccctcccccatccctatgggtcccgggtcactctgccctccccattcctagggggtcctggctcactctcccctcccccatccctaggggtcctgggttattctcccctcccccatccctaggggtcccgggtcactctgctttctccattcctagggggtcctgggtcactctcccctcccccatacctagggattccggatcactctcccctcccccatccctaggcggtcctggatcactctcccctccccattcctagggggtcctgggacactcctccctccccatccctagggggtcctgggacactcctccctccccatccctaagggggtcccaggtcactctccccaaccccatgcctagggcgtcctgggttactctccccacccccatccctagggggtcctgggttactctccccttccccatccctaggtggtcctgggtcactctcccctccccattccttgggggtcccgggtcacccttccctcccccatccctagggggtcctgggtcactctccccaaccccatgcctaggggttccaggtcactctcccctccctcatccttttgggtcccgggttactctccctacccccatccctagggggatcccggcttactctcccctcccccatccctagggggtcccaggttactctcccatccccattcctagggggttctgggtcactccctgcaaccccatgcctaggggtttcgggtcactctccccacccccatccctaggggggtcccgggtcacttgacctccccattcctaggggtcccgggttactctcctctcccccatccctaggggtcccgggttactctccccacccccatccctaggggggtctcggcttactctccctatccccaaccctggaggtcccgggttactctccccatccccatgcctgggggtcccgggttactctccccatccccatccatggggctccggggtcactctgctgtccccatccctagcggtcctgggtcactcctccctccccatccctagggggtcccgggtcactctccccaaccacatgcctagggcgtcctgggttactctccccacccccatcgctagggggtcccaggttacaggttactctctccaaccccatccctaaggtgtcccgggtttctctcccctcccccacccctaggggggtcccgggttactctcccctcccccatccctagggggtcctgggtcactctccccaaccccatccctaggggtcccgggttattctccccaaccccattcctgggggtctcggcttactctccccatccccatgcctgggggtcccgggttactctcctctcccccatccctaggggtcccgggttactcccccacccccatccctagggggggtctcggcttactctccccatccccaaccctggaggtcccgggttactctccccatccccatgcctgggggtcccgggttactctcctcatccccatccatggggctccggggtcactctgctgtccccatccctagcggtcctgggtcactctaccctccccattcctaggggtcccgggttacgatcccctcccccatccctatggggacccaggtcactccccacccccatgcctagggggttccgggttactctcccctcccccatccctagaggttccgggtcactctccccaaccctatccctggaggtcccgggacactctcccctcccccatccctaagggtctcgggtcactctcccatccctatccctagagttcctgagtcgctgggccctccggggttcagcccctccgtccccggtcccctgccccgcccaggcccaggccgtaccgcgttgctgaggatctcctgacggcgtggggaggcgctggccagcaccacgcgcttgtgcagcagcttcccaatcaccgggcacagcaccatggcgtccacgccgggagccgggcgtccgcacttctgagcccggagcccgcggtgcgcgcagcgcggctgcaaaaaaaacaggcggccagagtcccgcctccgcgaggccacgcccccgcccgcctccgcgaggccac

SEQ ID NO: 190 - DNA, 49840 bp, Homo sapiens; identical to SEQ ID NO: 189

SEQ ID NO: 191 - DNA, 74573 bp, Homo sapiens
tttgccctgtgcacttcaaagctcatgtttttttttaatgttttatttttattttttacagagatgagttctcactgtgttgcctaggttggcccttgaacacccggactcaatcagtcctcccgcctgagcctcccaaagtgctgagattaccggcatgagctgccacgccttgatggaggctgagactttttggaatccctccctctctccatgtcctgccaagaacagaagtaaagttttccatcttaaaacatgtgtgtgagtcaatagacctgtgttatcttttcactcaaagctcaaccagtgaacagactgagtcagcttccaggaaacatccacggctgtaagagggggtgtcggctgctctccatagccaagtggctgcaaaaatcatcatactgacaaaaaaaaaaaatcgacgcattttgcctgcttgcaacgtcttcctttgctgggggacgtcagggttctcgcacgttgtcgaggaaggatattgtctcggcttcctctgactcaagctctcatttttgtttacaaggcagtttagggatcgtccgtgcgttactgtgaagatgctactctgaggtttttcacagttttttttcccccatgagacacacccaaggcccacgctcagcacttgcgacctgtactcctgcagcctggatgcttctgtatcagctttgctttctagggttcagctttggaacagtctagagaagcaggaggttaattttcctccttctgtggaagttctgggtctcttacgcatcctccagttccccctggaggctctaggggaggatccttcctgcctctcccagctcctgggggctccaggtgtccctgggcttgtggccgcatcactccagtctgcctctgtctccacgtgtcctcctgctctgtgtctgtgtctcctcttctgtctcttggaaggacacctgtcatggcatttagggtgcttaataatccagcacaatctcatcttcatatccttaagtaattacacatgcaaagttccttattaccgaataaaatctataataatttcaggttctgggctttaaaacaagacatgtctttctggggcaactgtttagtgcactctgcaattgtatccagttccctccagagactctaggggagggtccttcctgcctctcccagctcctggggactccaggcatccctgggcttggggcagcatcacttcagtctctgcctctgtctttatgtggcctcctgctttgtgtctgtgtctcctcttccgtctctcatagggacactggattgggcccattgtaaatgcagtatggcctcgccttacttaattacatttggaaagacccgattttcaaacatggtcccatcctgatgttccaggtggacacgggtttgggaatgataattcattactaaaccatctctgttttcctgccatagtgatgacggcaggagagaggcaccaatagagggcctccgaacagcagcttcagcctccatcagcgtccccagtgcacagaaagggaggggccgggcatccaaggccacccactgcggagacgcagagcccgtgggcagacaggcagctctcccactcccacctccagaatggtctttctcgcccaagagagcctgggatccaattccacgtgatgtcccagcacccctggagagtcagagctcttctttgcgctaaaccagctcaggtgttggggctggtgcaggcacatgccgtgtagaagaagacagacaaagacccagcctgctcaccacccacacagcagggagggggctcagcggctgacacccctgtaggttcctggggtccacacctgcatctgctgcttggtctccaaacggtctcatgggtcaggccagttgcctgcttcctggactccagatggacttgccatggctgaggctctccatggggtaaaaggacgcggagaatgggcaggaggtggggaactcccgaatcaagctgcacccttgtgttgggatgggctggaccccatctcacggagcctcctttccgcacctgggcctcccgtggtccttgtcctgagtcagggaagcctgagtgtgttccaggggcctgatgggacctccttctctatcagggactcacagaagcagaataggggtggggtcccaccaagccaggccagaacaaatgtgccaaaaatcaccttggtcagcaacagggtggggtgtgtgtgtggggggaagtgggcacggagagtagctgacttgcaggagccccaggcgctcctctgaaagaagaattccaaccacagcaaccacagtgcccctgagtgaaataaacagaaatttcggcgtgcaccgggctacggagaccagaacccctggaggagaatggagaaggccagaaccacaactaagggacgatgtcagcagggagaagagctgggaatggggctcgcagttcgcccacggaggatatccagaaaccgagtcgggtaggcggtggggctggttgaatatccaccctcgggtatggacaggtgtgaggagtgtctaaggagctcgggggtgacagcccagctctactaaaaaaaatacaaaaattagccgggcgtggtgacacaagctgtcccctgacacagagaggcagaggcaccctctgcaggataacaagcaccctgtgcgctgctgggctttgcttgtttctctaccctgagtgaagcctggagacccttcctcaccggtgcctctgcagtgcctgggaggaataaagcctggagacccttccccaccgggcctctgcagtgcctgggagcaacgcagctgttctccctgaacctctggcaccgtggcctctccatgcgcccctggatctccaagctgcgcccccggctctccaagctgcgcccccgggactcagaacacactctcctgcctctggaggccgggcctggtggctccctccatcccttcagggtgcgcaccggcctcggagcgcacggacgtggtcctggcggagaagaggctctcgcggcgcgtgtccagggtgtctctgggcacccggcggcagcccaaatattcccgcaggcgcagctggaattcccgggacgcaaagtaataaacaaacgggtccagacagttgttgaggcagctgagacacagcgtgagcttgtacacgtggtagtagctcttgccgtagaacaggcggctcacgatgtgcgccaggagcacgaagttgttgggggcgaagcaggtgacaaaggccagcaagaccaccgcggccaggcccaccgcgcgcctccgctgctcccggccgtgcgcctcctccgtgcgcaacagcttgaggatggtggccgtgtaacaagccacggtgatcacgaacgggatgaggaacagcaggatgaagatggtgaagaggaacacggcccacatggccacgctggggagcatcgtccacttgaggacgtcgaagcaggtgatgatgcccagggcgtgcaccgggtaggtgagatcggtgcgcgccagcggggacagggcggtcaggagcagcagccaggtccctgcacacgcggccaccgcgtaacgacggcggcgccagcgcttggagctgagcgggtacaggacccccaggaagcgctccacgctgatacaggtcatggtgaggatgctggaatacatgtttgcgtaaaaggccacggtcaccacgttgcaaagcagcaccccgaatacccagtggtggcggttgcaatggtagtagatttggaaaggcaacacgctggccagcatcaggtccgtgacgctcaggttgatcatgaagatgaccgacggggatctgggccccatgcgccggcacagcacccacagagagaagaggttgcccgggatgctgaccgccgccaccagcgagtacaccacgggcagggccaccgcgatcgccgggttccgcagcatctgcagcgtcgcgttgtccgggccggtgctgttcgggacctgcatcctggaggggtcctcgcccgggctctgcaagggaaggagggaagggtgtacgggtcaggggcgcaggtaaagaggcggctgccgggagggctcctgagcgccgctccccggggaccaaggcgggggagatgctttagcagggcctgctgtctcctccctccctccctcccttagttcctccttccctctcctccttccttccctccctctctgcctcctttcttcaccctgtgtcattcttttcttctttcctgtcttctcccctttcttcttccttcctcctctctccttccttctcttcttccctccttccttccttccttccttccttcccgccctccctccctcccgtccttccttggatcagggaggtcattggagacctcggcccacgtcagaggctgagactcttagatgatccacagtggggctgtggctcccctgggcaggttgaatgcattgtcatacaaacctcaagactcagtgtcccccgtggacggaaaccacaaagccaccgtcagcccccagggtggtcttaatgggaattcttgacaccctggcagtattagtctgggtatgagtcctctcatctcaggggcatccacccacaaagtgtctatcagcagaaaacacacactccgagtgccaggagaccaacccgcagcctccaaagtctttccagcttttaacacccgcgtcaacccacggctcctccctgctctttcttcctccagaggagacctgcgacttcttaccaactgctctacaaacagcttcctcaagctggctttaaaatggcccggagttttcgtttcagtttcagggagaagttttctgacccgccggtccgtgcccaggtgtgaaacctacagttatgcacgagtcagcaccgctccccacggccagctgggcacctccagccacctatggcttcaggaggaaaagcagacccttccttctttgggttccgcttggtgtggccgtgggggacgtctggaaggagagacgctttatccatgagctggtgatgaaaaagtgtctgtcaaagggacactacttttattttgagaatgtaaagtggacagagctggaaacaggggtgccctggaattgttcttttgtttgtttgttttatagatatggggtcttgccttgttgcccaggctggagggcagtagtgcaaacgtaactcactgcagcctccaacgcctggcctcaagcaatcctcctgcctcagcctcctgagtagttgggactacaggtgagagtacaaccacgcccagctaatatttttattttttgtagatacagagttttgctatgtttcccaggctggtctcaaactcctggcctcaagcaatcctcctgcctcagcctcctgagtagctgggactacaggtgacagtacctccgtgcccagctaacatttttattttttatagatacacagttttgctacatttcccaggctggtctcaaactcctggcctcaagcaatcctcctgagtacctgggactgcaggtgcatgccaccctgcccagctaatatttttattttctgtagacatggggtttggctatgttgcccaggctggtctcaaactcctggcctcaagcaatcctcctgcctcggcctcccaaagcattgggattacaggtgtgagcaacacacctgggctggaatttgttgctttaactctccacgtaggcagcagtgcctcgcacacatttaaacaccacgtgctgttgaaagtcctacggtggcggcctcacccggccaccctcgtgtctgtacctgtgtggtctggggatccagcaagcagcctcttggcagccagatctgttgccatttcgagtctgtgccctgtggccaccggacagcccccggggaagacagacagccaggactgctgaggaacgcgcatgactaatcaagaaattacctctaactgatgccagctgccctgacacaggaggcacaggcttgcggtttgggccccgccggggctcagcgggcaggatggaaattttagaaaatcagcacaacggttgttcttggcggtgtctggcctgcagaggtggctgtccagaaatttctgggcactgaattgtctgaagcaacggacagaccacaggtgggcgctcaggggctgtaggtgggaccctcctctcctctctcctctctcctctctcccctctcccctctcccctctcccctctccctctcccctctcccctccccttccctctcccctcacccctccccttccctctcccctcacccctccccttccctctcccctctcccctccccttccctctcccctctcccctccccttccctctccttccctctcccctctcccctccccttccctctctcctctcccctctcccctctcccctctcccctctcccctctcccctctccttccctctcccctctcccctccccttccctctcccctctcccctccccttccttctccttccctctcccctctccttccctctccccttccctctctcctctccttccctctctcctctccttccctctctcctctccttccctctctcctctccttccctctctcctctcctttcctctcccctctcccctcttttcttttcgcagtctgtcatccaggctggaatgcaatggcgtgatctcggctcactgcaacctctgtctccctgcttcaagcgattctcctgcctcagcctcctgagtagctgggattacatgcatgcaccaccacgcctggctgattttttactttttgtagccccaaaaagagtttcaccatgttaaccaggctggtcttgaattcctgacctcaggtgagccaccagccccggcctcctaaagtgctgggatgacagtcgtgagccactgcacctggccaggttggaccctttttcttatgctttgcaggtaaatgcacacctgtctggcagcaatgcatccagcaatgtttctctcctcttgagggtctgtgtgtatctcctccagccctctcacttatttcttcttaaaacagctttgccagccgggcacggtggctcacacctgtaatcccagcactttggaaggccgaggtgggcagatcacgaggtcaggagatcaagaccatcctggctaacacggtgaaaccccatctctactaaaaaaacaaaaaaacaaaaaaattagccgggcgtggtggcatggtggcgagtcccagctactcgggaggctgaggcaggagaatggcctgaacccgggaggcggagcttgcagtgagccgagatcgcaccactgtactccatccagcctgggcaacagagcgagactctgtctcaaaacaaaacaaaaccaacaaacaaaaaaacagctttaccaagacgtgagttacgtaccataagctttcactcattcatacagttcaatggtttttaatatattcacagatgtgcaaacaacaccataatgcaattccagaaccatttttatccctaaacaaaactcaggacctggccgggcatcatggctcacacctgtaattccagcactttgggaggccgaggcaggtggatcacctgaggtcaggagttcgagaccagcctggccaacatggtgaaatcctgttgttactaaaattaaacaaacaaacaaacaaaaacaaatgggccaggcgcggtgactcacgtctgtaatcccatcactttgggaggccgaggcaggtggatcacctgaggtcaggagttcaagaccagccttcccaacatggtgaaaccctgtctctactaaaaatacaaaaaaaattaaccgggtgttgtggcacatgcctgtaatcccagctactccagaggctaaggcaggagaatcgcttgaacctgggtagggggcagaggttgcagtgagccgagatcacaccattgcactccagcctgggcaacaaaagcaaaactccatctcaaaacaaaacaaaaacccttcagaaccccacaactgctaatcctgttcgttcctgtccccagcccctgtgaacctcaaatctgcttcctgtctctgtggatctgcctattctagatattttataagaataaaattctacaatatgtggtcttttgtgtctagcttctgtcactgagccaggggtcttcaaagttcatccacgctgcagcctgggtcagagcttgagtcctttcagtgggtgcataatagtctactgtgtggatagaccacattctgtttattcattctcctgtggatggacatttttgttctttctgatttttttttttttttttgagatggagtcttgctctgttgcccaggctggagtgtagtggtgcgatcttggctcagtgcaacctccgcctcctgggttcaagcaattctcctgcctcagcctcccaagtagctggggctacaggaacctgccaccacgcctggctaatttttttgtaattttttttttgagagggagtttcgctctttttgcccaggctggagtgcaatggtgtgatctcggctctcggcaacctccgcttccccggttcaagcaattttcctgcctcagcctctggagtagctgggactacaggcatgcatcaccgcacccagctaatttttgtatttttagtagagacagggtttcaccatgttggccaggctggttgtgaactgctgacctcaggtgatccaccctcctcagtctcccaaagtgctgggactacagacgtgagccaccgcgcccagcccattttttttttttttttttttttgtaattttagtaacgacggggtttcatcatgttggccaggctggtctcaaactcctgacctctgatgtatgatccaccctcctcggcctcccaaagtgctgggattacaggcacgagccatcacacccagcccattttttttttttaataattttagtagcgacaagctttcatcatgttggccaggctggtctcaaactcctgacctcccatgatctgcccgcctcggcctcccaaagtgctgggatgacaggtgtgagccaccgcgcctggcgtgttcctgattcttggctattgtgcataaagctgctcttccctcattcccagccctgggaacccctttctaaagggttcagatgctgagtgcagtgatcactacagtcttgttccgggtggaccttacagggttgggatgagaaatagacaaaaggcatctcctcgtgggcagcagggattgcatgccggtgacagacccttttttgccagctattgtcttctggctataaccacccctctttcctgagtgctgggggctgtcccagctgttgaacacacaggggagtgagaggccccagccctaaggaaccacaagccagccccgtgcttgtcgtctgctctcctttctgttttctgggggtgtttgcaccacccagtttgtggttcttttgatagggctgcctcaggaggccctcaaccccaaagacagcaaatggcactctgttggagctgtggatttggaagacaaaacagacgctggcttcaattacctactttgattacgtagaaggaagttgtcgtgggccacaccctggctgatactctcggtattatggccatttcttacttagaaatagggtctgcgtctatgtcattagtgaagtcaaaatgtggtcataatagagtagggagaggccctaataaaattcactggcgtccttaggagaaagagaaatttaggcacagacacagagagaaggcatggaaagatgaagacagagacgagagtggatggatgggtagatggatgaataaatggatggatgggtgggtggatggatgggtagatgcatagatgggtggatgaatgggtacatgggtgggtggatggatggatgggtgggtgagtggatgagtgcatgggtgggcagatgggtgggtggatggatgggtggatgggtgggtgggtgggagggtgggtgtgcggatgaatggtaggtgggtttgtgaatgggtgggtaggtgggtgagtgggtggatggctggatcagtgtttagataggatgtgtgggtggatgaatggatgggttgatgggtagatggatgggaggatgtatggatgaatgcatggatgggtggatgggtgggagggtggatgtgtggatgaatggtgggtgggtgggtggatgtgtggatggatagatcagtgtttaggtggatagatgtgtgggtggatgaattgatgggttgatgggtagatggatgggtggatgtatagatgagtaggtggatgggtgggtggatggatgagtggctagatggatgagtgggtggatgggttggtggatggatgatgaatggatgtggatgggtagatggatgggcgggtgagtggatgagtgcatgggtgggcggatgggtgggtggatggatgggggtgggtgggagggtggatgggtggatgaatggtaggtgggtttgtgaatgggtgagtgggtgggtggatgggtggatggatggattagtgtttagataactggaagtgtgggtggatgaattgatgggttgatgggtagatggatgggtggatggatgggtgggtggatggatagatgagtaggtagatggatgggtggatggatgggtgggtggatggatagatgagtaggtagatggatagatgagtaggtagatgggtgcgtggacggatgggtgaatagatggatgagtgggtggatggggggttggatggatgatgaatggatggggatgggtagatggatgcatgggtggatgaatggtggatgggtttctgaatgggtgagtgggtgggtgggtggatgggtgggtggatggatcagtgtttagatagatggatgtgtgggtggatgaatggatgagttgatgggtagatggatgggtggatgtatggatgagtaggtggatgactgggtgaatggatggatgcatggatgggtggatggatgggtgggtgggtggatgaatggtaggtgggtttgtgaatgggtgggtaggtgggtgaatgggtggattgatggatcagtgtttagataggtggatgtgtgggtggatgaatggatggattgatgggtagatggatgggtggatgtatagatgagtaggtggatgtatgggtggatagatggatgactgggtggatgggtgggtggatggatgatgaatggatggggatgggtagatggatgggtgggtggatgaatggtgggtgggtttgtgaatgggtgagtgggtgggtgggtggatgggtggatggatggatcagtgtttagataggtggatatgtgggtggatgcattgatggttgatgggtagatggattggtggatgtatagatgagtaggtggatgggtgggtggatggatgggtggatagatggatgagtgggtggatggacggatgcatggatgagtggatggatgggtgggtggatgggagggtggatgggtggatgaatggtaggcgggtttgtgaatgggtgggtaggtgggtgaatgggtggatgtatggatcagtgtttagataggtggatgtgtgggtggatgaatggatgggttgatgggtagatggatgggtgggtgtatggatgggtggatgaatagatgagtaggtggatgggtgggtggatgggagggtgaatagatggatgagtgggaggatgggtgagtggatggaggatgaatggatgaggatgggtagatggatgggtggatggatagatgggtggctggatagatgaataggtgtatgggtgtgtggatggatggatggatggatggatggataagtgggtgggtggatggatggatcagtgtttaggtggatggacgtgtgagtggatggatgggtggatagatggatgagtgggaggatgggtgaatggatgtatgatgaatggatgaggatgggtagatggatgggtagatggatagatgggtggctggatagatgaataggtgtatgggtgtgtggatggatggatggatggatggatggatggatggatggatggatggatggataagtgggtgggtggatggatggatcagtgtttaggtggttggacgtgtgggtggatggatgggtggacagatggatgagtgggaggatgggtgaatggatgtatgatgaatggatgaggatgggtagatggatgggtgaatggatgtatgatgaatggatgaggatgggtagatggatgggtggatggatagatgggtggctggatagatgaataggtgtatgggtgtgtagatgggtggctggatagatgaataggtgtatgggtgtgtggatggatggatggatggatggatggataagtgggtgggtggatggatgaatcagtgtttaggtggttggacgtgtgggtggatggatgggtggacagatggatgagtgggaggatgggtgaatggatgtatgaggaatggatgaggatgggtagatggatgggtagatggatagacgggtggatggatagatgaataggtgtatgcctgtgtggagggatggataagtgggtgggtgggtgggtggatggatggatcagtgtttaggtggctggatttatgggtggatgaatggatgggttgatgggtagatggatgggcagatgtatggatgggtggatggatggatgagtgggtggatgggtaggtggatggatgggtggatggatggatgagtgggtagatgggtgggtgggtagatgggtggatggatgaatagatgatgcatggatggatgcttctatccaccatgaaatgccgattgtttccagaaaatcaccagaagctgcagcaaagcttggaacagattttccctcagagccctaatgaggaaccaaccctgccaataccttcatctcagacttctggtctccaggatggggagagaatgcattgctgttatttaagccaccacatcagtggtaattagttatggcagctgtcgcaaaccaatacaccgagaaaagagaggaaaagttttaaccaacagacttcaaagaaattagagaaagcgtcatcataccaaataaaagagaggaagaaccttaaaagaaagataaagcatgaaaagcacaagattataggataagagaaagaaatgaggaacaagccaatgggcctcagaaactcaatggaagacaaggatctcaagacttgaagatataaagacggcactgcaaagcaataacaacaacaacatgtattcatgcagtccccctttctttggttgacttactgttgagaaatgtccaacactagcagagtggagcatatagattatgatgtgatttgccaaagcccaggaggaatggctgcataggaccctctcctcacctgccatggttgcattgaaccactagggtagggaaggaagcaaggctcagagctccctgctcaagcatctccctgcaggggccaagacatcttcttgacctttgacatgtggatctatggcacaggggctgtccagagctctccatgacccaggcatcagaccccttccagctccaggagggaggaggtacaggtatacacctggtgctgacctacaagggtcacaggaagaatccagctttgggacacctcctatgaccaagttgttcaggattttacaatgtggtctcagggtcactgttagtgcacccagacctgtttgagcaagagtccttgatatcgatttagaaatataatgggtcggctgggcacggtggctcatgtctgtaatcccagcactttgggaggctgaggtgggcagatcatgaggtcaggagatggagaccatcctggctaacacggtgaaaccccttctctactaaaaatacaaaaaagaaaaaaaaaattagccgggcgtggtggcgggtgcctgtagtcccagctactcgggaggctgaggcaggagaatggcatgaaccccggaggcagagcttgcagtaagcctagatggcaccactgcactccagcctgggtgacaaagtgagactctgcctcaaaaagaaaaaaaaaaaagaaatataatgggtcatatagatgtttgagaggtagccaagggtggctgatgccaggtctagaagaacaagggtcacctagaaggcttcccctaccctcaagaatagttggaaatgtaggaaacatccctggttgccacaacttaaggaaggatgctactgggatctggtgggtggagcccagggatggtgctcaacaccctaccatgcacaggagggtccccaccacagagaagcatccagcctcaaatatctacagtgctgaggttgacaacctggcatgagcataagaacttcaccgtcagcctggagcagtggctcacacctgtaatctcagcactttgggaggccgaggtgggtggatcacctgaggtcaggagtttgagaccagcttggccaacacggtgaagccccgtctctactcaaaatacaaaaactagccaggtgtggtggcgggtgcctctaatcccagctacttgggaggctgaggcaggagaagcacttggacctgggaggcggaggttgcagtgagctgagattgtgccattgcaccccagcctgggcgacagagcaagactgcatctcaaaaaaaaaaaaagaagaagaagaagaagaaattcaccatctgtctatccatgaatccatttgttgatctaacccctgtcatccatctatcatctatcatctatctatatcaatcgtcttgcaacccttgatctatcatctatctatatcaattatctatcaatcgatcatctatctacctatcaattttctctctatcaattacttatctatctagcaatcatatctatcaattatgaatcaatcatctttctatggatctttcatctattcatatcaattacctaccaatcagttatctattaattacatctatcatctgtgaatcagttatctaacaatcacatatacgtgttcatcaatctatcaattatttatctatgcatcaattatttatccattcaatagtttgcaaatgtgaatgattcaggtatcataattgggaagatgcgtctggcatctggtgggtagatcccagggacactgctcaacaccctacagtacacaggatggccccaccacagaggatcatctgggctgaaatgtcagcagtgctaaggctgagaaacctgccctcaagcaactgtgtgacaagagcagccttcaacaaacacacagagctcaggagtactttccaaagaatgtctgcaagaggctttcggggagagaaaagaccccaggcagatgttcctagcaagaagctggtgtcgtggaaagggacagtggtctcatcatggttagtgaccagctgtggatgaagagcgattccttaaaatgcctgcacgtgcccctcattgccttgccgtcacggacctcccaccccatcacagaggaggagacctggtcttcaggaagacagatggaacatgagctaaagcatctcttgggcccctgagctggggtggggtcagacgtcagagctgtggccagaagcaataacaaagagaagttcttgactcatgtggaaccttccattggtatctcctgtttccaatcctaagcatttctctgtatgatggacaccaatgcttttaaaatgaaaaatggtgctggcaggcgtatgtgtgtgtgtgtgtgtgtgtgtgcccagcagggaagcagaaattattaccaacatatcttttgcaaacagggatcatataaactagagagattgcagaaggcagactgtagataagagattgcagagaggttgtagggtgacagacaggtccttttgggagggaggaagtaggaagagagttggtggttttcaatatgggaagctgaagtggcacaggtatcttttatttatttatttatttttttgagacagagtctcgctctgttgtccaggctggagtgaagtggcacgatctcggctcactgcaacctccgcctcccgggttcaagcgattctcttgcctcagcctcctgaatatctgggactacaggcgcctgccaccatgcttggctaatttttgtatttttagtagagatgggggttccagcatgttggccaggctggtctcgaactcctgaccttatgatccacccacctcggcctcccaaagtgctgggattgcaggtgtgagccactgctcccggtacaggtatctttttatgtgaacatagatagcaggggctgggaaaacagagaagctaggtggtgggctcatggtgcaaagactatcatggaatataccagaagcctcctgccccctgctgtctgcctttctggtggtccctccccactgaactgcaacttatcctaataaaaccggggttgataccaccacttccaggttcccacattccaagtcccctcagccacagaagcagatgcaacctcttctgaacttccagacaccattgagttttcaactttggtttaatttttagatcttccaattacagaacacacacacacacttgttatgagtaaaagaataaagagaaatagagagctctgtattcgtgtttgtctttggatctttcccctccaggtcccacttcccttcagaagtaacctctgggagttcgtttgctctggagcctcctttcatacacaggtaagttttattttgcatagtaggacatacacccgtcaccacttttgtgaatgtcttgtggtgtctctaaccatatgccccacagtgaggggatttggatggatcaactctgcttcagcctgtgtgcttacacacactcctctgtaagtatttttatgcatacctgtgagaacattttctaggatcgatttctaggagaagatctgctgatttgaagggtttgcatattttaaatggaatgcatgtattagaaaggaagtaagatctaaaatcaataatttaagtttccacctcgagaaactagaaaaagaagagcaaattaaatctaatggaagaagaaagaaataaatcataaatattagattagaggagaaatcagtggatttgaaaataggaaatccatagaggacagaaatcagtgcaattgaaaacagcaagtcaatagacaaaaatcaaaaccataggcttgttctttgaaataacaatcaatgagagtaataagcttctagtcaggctaacaacaacaaagaatgaggacacaagttactaatactgtaaatgaaagaggagacatcactacagatcccatggacattaaaaagatcataaagaaatattataaacaattctgtgcccataaaattgatcacctagatgaaaagaacaaaaggataaaatctgacaactcacacaagaagaaacagccaatctgagtgagcctatatctcttaaagaaattgaatcgataatttaataaccttcccaaacaaaaggctccaggcccagatgggtttactgatgaattttccccaacatttaaggaagaaattatattgattctctaccattccttccagaagatagaaacacagggaatatcaccaaatatccacccaataaatttcaccaatatgtgcttacagctgatagacaagggcaacactcattctcacaccctcatcaacaagggtgacagcaactagcctgaagggtgagaggtttcaactcatattttcatcacagcaacagaggttgacatgtttctttcttttctttcttttttttttttattggctgagtcagagtttccctctgtctcctgagctggactgcagtggcacgaccttggctcactgcagcttgcgcttcccgggtttttttttttttgagacagggcctttctctgtcaaccaagctgggggcagtagtgcaatgaccgctcactgcagcctcgaactcctggcctcaagagatccttctgtctcagcctcctgtgtaagctgggacatggatgaagctggaagccatcattctgagaaactaacagaggaacagaaaaccaaacactgcatgttgtcactcataagtgggagttgaacaatgagaacacatggacacagggaggggaacgtcacacaccagggcctgtcggggggtgaggggatagaggagggagagcattaggacaaatacctaatgtagatgacgggttgatgggtgcagcaaaccaccctggcacctgtacacctatgtaacaaacctgcatgttctgcacatgtaccccagaacttaaagtaaaataaaaagaaaataaaagaactttttttaaaacaaagaaccagtatgcaaaatgtgccaaaaaaaactcttaagattcaaccactggaaaaaaaaaaaaccatttaaacatgggccacctcacgaaagatgctttgcaggtggcaaattcacctacgaaaaatcactccatgtcgtagctcatcagggaattgcaaattaataccgccgagacatgccggccgacaggtctcagggtgactaagatctagagataccaacagatgaagtaccggaactctcattgaatgctggtcacaagaagacggtccctgcaccctctgacctttaggtcactctgcagcacgcaatacattttttttttttcttgaggctgagtcttgctctgtggtccaggctggagtgcaatggcacaacgtcggctccctgcaacctccgcctcccgggttcaagccattctcctgcctcagcctccagagtagctgacaggcacctgccaccacgcctggctaagttttgtgtttttagcagagatgggatttcactatgttagccgggctggtcttgaactcccgacctcaggtgatccacctgcctcgacctcccaaagtgctgggattacaggcgtgagccaccgtgcccggccaggtagtcacattttcttcaagctttgggtttaagggatcccagctttgggcttaagggatcccagctttgggtttaaggagcccagctttgggtttaggagagtccagctttgggattaggagagtccagctttgggattaggagagtccagctttgggattaggagagtccagctttgggtttagtggagctcagcttccaaccctcgcaccctcaaagttccccatctttgtagacccagtgacccctgtttctgtgataacacctgcctctgaacgaactctgtgttctactgacttcaaagtgacccaccagccccagtgaactggcagctggcaggcgtcaggggatagaggacctgctggcgtcggcctcagatcacaaggcaagaatcctcctagctaagcacaaaaacgcgtaggaaatgctctgagctctgccgctgtgtgttgattttcctgtattgcatcacccaacgaagcagaccgtttgcccagcgagatttgcatgctgtcctccgcagacgccccgtggagattttgatctgcgtcttctgcaaaggcagcggccgcgtttctctgatttctgtatctcattctcagagtatatagcacggggcttcatcgctggccagagagcagattctgagaaacataagaagcccctttttgaaacaaaattaatttgtgtgtgtggtgtgtgtgtgtgtgtgtgtgtgtgtgtgtatgggtgaggatgtctcaacagcagcaaaatcggcctcactctggaaggcaggaagccactgtacgtggaattaagctaattaacatgaaatgccatttggtgaaaaaaaaaaaaaaaacccaaagtggttgagtgtgtggctcctgccctgctgcaaaagaagagtgtggaaatagcacgtatgctgaaatttaagcacttctgccgttactgagccacagtgcccatggttttagcaggttatggcagacagattcatttaacagatgagagagaggtgacaggaaggttcgcaggcttgacttcctaacagctgctctctgtttaaagatcgttgctctagacatgaagtccttgcccatgcctatgtcctgaatggtagtgcctaggttttcttctagggattttatggttttagatctaaatttaagtatttaatccatcttgaattaattttagtataaggtgtaaggaagggatccagtttcagctttcaacatatggctagtcagttttcccagcaccatttatgaaaatgtggcacatatacaccatggaatactatgcagccatcaaaaatgatgagttcatgtcctttgtagggacatggatgaagctcgaaaccatcattctcagcaaactatcgcaaggacaaaaaaccaaacactgcatgttctcactcataggtgggaattgaaccatgagaacacatggacacaggaaggagaacatcacacaccggggactgttgtggggtggggggacgggggagggatagcattaggagatatacctaatgctaaatgacgagttaatgggtgcagcacaccaacatggcacatgtatacatatgtaacaaacctgcacgttgtgcacatgtaccctaaaacttaaatgaaagataaaatcaattattttaatttaaataaataaataaagatcgttgctcagtgtgagttgacgcggacttgccttaggatactttaattgtgatctggtggattctgctcatcctgtttccagccatgtgctcagcaaagcagtcaaagagaaagatccctggagaagaaaccgagacggtctcaactaccttgttcctgcccgaagtcaaagctgggctcccttagatccaaagcggggtttccttaaaacccaaacaggagccaggcgtggtggctcatgcctgtaatcccagcactttgggaggctgaggtgggtggatcacctgaggctgggagttcgagaccagcctgaccaacatggagaaaccccatctctactaaaaatacaaaattagccaggcatggaggcgcatgcctgtaatcccagctactcaggaggctgaggcaggagaattgcttgaacccgggaggcagaggtcgcggtgagccaacattgcgccactgcactccagcctgggcaacaagaacaaaactttgtctaaagagagagaaaaaaaagaaacaacccaaacaggagctccattaaaacccaaagctaccctcccttagactcaaaaacaggcttccttaaaacccaaagaggggctcccttagacccagagctgagctccccaaaacccaaagttggactcccctaaacccaaagctgagctcccttaaccacagagctgggctctcctaaacccaatgctgacctcctttaaacctgaagctgggctgccttagaccaaaagctgggctctcctaaacccaaacctgagctcccttaaacccaaagctgggtttccctaaaactcaaagctgggatcccctaaacccaaagctgggttcccctaaacccaaagctgggctcccctcaactcaaagctgggctcccttagacccaaagctggactcccctaaacccaaagctgggcccttatatacctaaaaagctgggttcccctaaacccaaagctgggctcccctaaactcaggaaagattttcatctttgaacacaaaggagtgtgtttttctcttgctccctggacccaaacccccaatgacgggaaccctcagctgtgacaagcctccagtatacgtatttccccacgtgtgagccagtttcaatctctctcctctgaaaggtgaaagggtcccaaggtagcagtgatcatagacagagactcatttctttgttctctttgtgacctaagggaggttctcaggcccacagaaaaggatattttaaaagatttcaaagcagtacccatcctaggctacccctcagcacaagaaattaacattacaggccgggcgcggtggctcacgccagtcatcccagcactttgggaggctgaggcgggcggatcatgaggtcggaagttcgagaccagcctggtcaacaaggcaaagcctcgtctgtactaaaaatacaaaaaaaattagccgggtgtcatggcaggtgcctgtcattccagctactcgggaggctgagacgggagaattgctggaacccgggaggcggaggttgcagtgagctgagatcacaccactgcactccagcctgcgtgacagagcaaaaccctgtaaaaaaaaaaaaaaaaaaaaaaaagaagaagaagaagaagaagcggcagctggggaaccttcctgagcaaaaactagaatcctctgtgtcccattcaagtcctgcgtgtttgcaaattgactccaaaaatcacctggtgtgtcctcaaatagttaaccatgtcatgcaccaattctcctcctaggtaaaagctggagacaaataaagacaggtggagaatttgttaagcaaacatctgattccttaatgatgtaataatgtctttttttttttttttttttttttttagagacaggattgcagtttgttgctcaggctggtctccaagtcctagactcaagaaatcctcctgcctcagcctccaaaagtgttgagattacaggtctgagccactgcacccagcccttagtaatgtcttttttcttcttttgaaggtggtttctcactcggtcgtccaggctggagtgcagtggcttcatggcggctcacggcaaccttcacctctgggcttcaagcagttctcgtgcctcagcctcccgagtagctggaactacaggtgtgcaccaccacgcccagctacatttttgaattttagcaaagatgggcattgtaccatgttgcccaggctggtctcaaattcctgaggtcaggcaatccacttgccttggccacccaaaatgctaggattacaggcgtgagccactgcgcccagccccttaatgatgccttactgtaaattatgggtaaatgtgtacacattaaattaaatattaccttattaacattttatttacttttgtttctcttttatattgtaattaaggctatatggatatgtaaatttaatatgtaaataatatacataatcatataaagtgatataatgtataaattattattatataatattacatatattatttatatatattattgttatataataatttatttacaacttattttattataaattaaacatgttatattgtatgtatatttaataattatatacgatatattgtatagtatcatttatatgttatatataatttgtgtattatatgtaacatattgaacatagcatatataaaattatatacaacatattttatagatcaccttatgtgtatatataattatatgtataatacattatttctgcatgtcattttggtaagtgaaggtagcattagaaaatgtataaaaaggggctaggtgtggtggctcacacctataatcccagcactttgggaagctgagacaggtggatcacctgaggccaggagttcaagaccagcctggccaacatggtgaaaccctgtctttactaaaaatacaaaattatctgggagtggtggcaggcacctgtcatcccagccacttgggaggctgaggcaggagaatcgcttgaacccgggaggcggaggttgcagtgagcggagatcatgccattgcactccaggctgggtgaaaagagtgaaactctgtctcaacaacaacaaaaaatggttgcacccataaaaacttgcatatgaacgttccctgcagcactcttcacaacagccaaaaggtggaaacagcccaagtgtccgtcaacagacagacagataaacacaacgtggcccccccatgcacacagtggaatagtatacagccatgaaaaggaagaaggctgtgaccgaggctacactgtggatgaaccttgaagacatcatgctcagggagagaagccagacacagaaggccacatggtgtaggactccatttcaataaaatgcccagaacatgctgatccatatagagagaaagcagatgaccatggctgggactggggatggggaaacggggagtgactttccccctaaagggggtgtttccttttgcaggaatgacaaagtggtggaaatagacagaggcggctgttgcccagcactgtgaaggtcctaaatgtcccccagttattcgctttaaaacggtgagttcatgtcaagcataatctcaacaagaaacaattgtctcttgaagcaggaaggacattcctcaggtttctggtttacttcctgcgtctgagctggcccttcccctacaccctcctggctgactccctgcccgcgctgagtcctgaatgctcctgcagtctcagtgctcccccgcttgttgcttgggtcttcctgtccctcagagagccccggtcacagccaggctgaccctttctccccgggacagggcagccccagggccgagcttccgcttttgggggatgcagtcgtcactggggccgtagccagcctggcctcctcatccctcaggtccctaccggggtgtctggggccggctgcgcaagccttccctgtctgtggtcactatggctgatttgagcttggctgggcctgagtggaggggaagcagtggccaccactgtgtgaaccagtgacctcacggtgtccctcagggagccacagtgaaaggcgtccaagttctcaagtccagcattgtttcaatttcctccttgtctttcccggccacacagagcttccttcctagctgcctggagatgacagggaaggagaaggtcaagtgtgcttgagtcctcaggtgacatcgcctgttcttagagcagacgtcacattgaatgtttgcaaacgtttttttgtgcacccgtcctaggaagacgcgcttatcatctttgctttacatatggggacactgaggggcagagggcataaggaacctgggccatgagtgacaaggggcgtggtgcttgggacccagactgtaggttttctgggcatgtagaagatgccgcactctgccttgcaataatctccaaatacacgcatctgagtggaaacacacctgcgcctctgagcctgaactctgcacctgtctctggctgcctgtctcatcctccctgccctcccaaggggatttcagggaccatactgcatactgagagctccccaaggagaagagacctgaagtgtatcatcctggtgctccctgaggctggagcatagtcctggcctgctgggcaggtgcatttgcacctgctctttgcaggggttggggacaagtcagaatacgggtaaaaaagaaggccgggccaggcgcggtggctcacgcctgtcatcccagcactttgggaggccgaggcgggtggatcacgaggtcaggagatcgagaccatcctggctaacacggtgaaaccccgtctctactaaaactataaaaaattagccaggcgtggtggtgggcgtctgtaatcccagcaacttgggaggctgaggcatgagaatcgcttgaacctgggaggtggaggttgcggtgagccaagatcgtgccgctgcactccagcctggccaacaagagcaaaactctgtctaaaaaaaaaaaagaagaagaagagaagtgggtctcaacagggtccccagtgtatcactaacagctgagcccccaggagcccctcagcctgcctgagttattcctggagaggcagaacgagctgaggaatctcactgcctggttctgccctaaaccaccctcctgggaaggggtgaatgcaaagctaccaagtgactactactcaaaggctggggtggtgtttcccctgctcgctgtcaggcacagatgatgtgcttatgccagtttccttggtacagtggtctacctggccctgcagaaagctgtgtccccacagcggtgggaccaactcacagatatctccttgccctagctcctgtgattcctctggcccatgcagctccttatgcctgtctgcacccagcacagtcttgagtgacaccttcaaccctccttcttggggcatcagcccaccatggacctgccagagcctcttggaagtctgcatttcattccagcccatgggtgccagctcctgcctccatgaagaccctctcctccccaccaggtacctgctgcaaactcctttgggtctgctgtccttagcttagagctgtgcacccaggatggtcttggtaaatgcagggtgtgtgtgtgtgtgtgtgtgtgtgtgtgtgatacaggacattcccaatgactgtggagggaatgaatgggtgcatgtatgaataacactcagagcgtccacacaaatgtggagagaatgaatgaatgacatccaggattcagttatgcaaatgtggagggaatgaatgaatgatacccagggttcactcccacaaatgtggagggaatgaatgaatgaatggcatccagggtacactcctgcaaatgtggagggaatgaatggatgatacctaggattcactcccacaaatgtggagggaaagaatgaatgacacccagagattcattcccacaaatgtgcagggaaagaatgaatgacacccaagattctcttctgcaaatgtagagaaaagtaatgaatgatgcccagggcttccccacaaaagtggagggaatgaatgaatgacacccaggattcacttcggcaaatgtagagagaatgaataaatgatacccagagattccccacaaatgtggagggaatgaatgactgacacctaaggattccctacaaatgtagagggaatgaatatcactcagagatttactcctgcaacagtggagagaatgaatgaatgaacgacacctaaggattcctcacaaatgtggagggaatgaatgactgacacccaggattcacttccgtaaatgtagagagaatgaatatcactcagagatttactcctgcaacagtggagagaatgaatgaatgaatgacacctaaggattcctcacaaatgtggagggaatgaatgactgacacccaggattcacttctgcaaatgtagagagaatgaatgaatgatacccagatattccctgcaaatgtggagggaacgaatgaatgacatccagggcttccctgcaaatgtggagggaacgaatgaatgataccccagattcacttctgcaaatgtagagagaatgaatgaatgatacccagatattccccgcaaatgtggggggaatgaatgaatgataccccagattcacttctgcaaatgtagagagaatgaatgaatgatacccagatattccctgcaaatgtggggggaatgaatgaatgacatccagggattctccacaaatgtggagggaatgaatgaatgataccccagattcacttctgcaaatgtagagagaatgaatgatacccagatattccccacaaatgtggggggaatgaatgaatgataccccagattcacttctgcaaatgtagagagaatgaatgaatgatacccagatattccccacaaatgtggggggaatgaatgaatgacatccagggattctccacaaatgtggagggaatgaatgaatgataccccagattcacttctgcaaatgtagagagaatgaatgaatgatacccagatattccccacaaatgtggggggaatgaatgaatgataccccagattcacttctgcaaatgtagagagaatgaatgaatgatacccagatattccccacaaatgtggggggaatgaatgaatgacatccagggattctccacaaatgtggagggaatgaatgaatgataccccagattcacttctgcaaatgtagagagaatgaatgaatgatacccagatattccctgcaaatgtggagggaatgaatgaatgataccccagattcagttctgcaaatgtagagagaatgaatgaatgatacccagatattccctgcaaatgtggggggaatgaatgaatgacatccagggattctccacaaatgtggagggaatgaatgaatgataccccggattcacttctgcaaatgtagagagaatgaatgaatgatacccagatattccctgcaaatgtggggggaatgaatgaatgacatccagggattctccacaaatgtggagggaatgaatgaatgataccccagattcacttctgcaaatgtagagagaatgaatgaatgatacccagatattccccacaaatgtggggggaatgaatgaatgataccccagattcacttctgcaaacgtagagagaatgaatgaatgatacccagatattccctgcaaatgtggggggaatgaatgaatgataccccagattcacttctgcaaatgtagagagaatgaatgaatgatacccagatattccctgcaaatgtggggggaatgaatgaatgaatgataccccagattcacttctgcaaatgtagagagaatgaatgaatgatacccagatattccccacaaatgtggggggaatgaatgaatgataccccagattcacttctgcaaatgtagagagaatgaatgaatgatacccagatattccctgcaaatgtggggggaatgaatgaatgacatccagggattctccacaaatgtggagggaatgaatgaatgataccccagattcacttctgcaaatgtagagagaatgaatgaatgatacccagatattcactgcaaatgtggggggaatgaatgaatgataccccagattcacttctgcaaatgtagagagaatgaatgaatgatacccagatattccccacaaatgtggggggaattaatgaatgacatccggggattccccacaaatgtgaagggaattaatgaatgacacacagagattcattcctgcaaatgtggagggaatgaaggaatgagtagcacacaggacttgcttgataaacgaatgggtgaatacataaatcaatgacgtgtagggttttctccctaaaagtggagtgaataaatgaaagagtgaatgcatgatgcccactagttcctgacaagtgtggagcaaatgagtaaatgagtgaatgaatgaatgccactctgagaatgcacagccaatgagtgacggaatgtgtggagcaaatgagtaaatgaatgaatgaatgaatgaatgccactctgagaatacagagcgaatgagtgatggaatgtgtggagcaaatgagtaaatgagtgaatgaatgaatgccactctgagaatgcacagccaatgagtgacggaatgtgtggagcaaatgagtaaatgaatgaatgaatgaatgaatgccactctgagaatgcagagcgaatgagtgatggaatgtgtggagcaaatgagtaaatgaatgaatgcatgaatgaatgcatgaatgaatgccactctgagaatgcagagtgaatgagtgatggaatggacagaaggcggcaggggcagtgtggacgttagccccaccgcctccctccggtccactttggtccagcttgctactggccctgacctctctgctgcatccatggaaactgtgcacccagcacccctcgcccctggggtcactccctgtctgggctgtgtggttctccaggactgccaatcaatgaggagaggggtgtggtccaagcctttcaatcactgaggataggggggtgtggtccaagcctgtcaatcactgaagatgggggtgtgtggccaaagcctgtcaatcacccaagagaggggtgtggcccaagcctggccagttagggggccaccctcaccctgttcataaaaattatctcaagcagtggtcatttgtttctgacatggctggtcggaacccttcaggaggtgtaacttgtgggtgccaggagagagagggtgtctcttttcccatttgattctgctctgaaaagatggggaccccaggctaccagagaccctctttccatccctatagagaaagtggtcttcctccagtgattccacaccctgcagctgagggaggcagaaaaaggtggggctgaaacgtgggaagagagaaagagaaagaggagaaactgacaaccatgtaagctcctggatccagccatgcctgaagcccccatagaaatcctaattatccaatttgacaatttccaccttgacttcagctagctcgactcaagtttctattgctggccatagaagacagttatgcctcaagcactaggggtaggcaggttgggctcccagttgagggacagaattgtcctagttccagagagagggcccacggagcccaggccacctgccctgggctgagacatggttgtttcaaaggcagtcacgtatcattcatcactaattccccagtgcagtggttcaaggctaacgagcagcactcagcgcccacctctgcctctttctggttgtaggtcttgaacacacccccgcctccatgtctgcctcagtttccgttactggtaaaacagggatgattgtaacagcacctgtctcacgaagtttcgaaaatcccagagatcaggccaggcgcactttgggaggccgaagcgggtggatcatgaggtcgggagttcgagatcagcctggtcaacatagtgagaccccatctctactaaaaaatacaaaaaattagccgggcgttggggtgggcgcctgtaatcccagctacgtgggaggctgaggcaggagaatcacttgaacccgggaggcggaggttgcagtgagcagaggtcacgccactgcactccagcctgggcaacagtgcgagacaagaaaggaaagaaaggagaggagaagagaggacaggagaggaggggaggggaggggaggggaggggaggggaggggaggggagggggagggaggaaggaggaaggagggagggagggaaggaggaaggaggaggaaggaggaaggaggagggagggaaggaggaggaaggaggaaggagggaggagggagggagggaaggaaggaaagatcgcagagataaagcccttgtaaaagtggctgctgcttcctcctcactcagtcgacgtgaactatttttattagcgaaaaaccaagaacaacgtctcctccccacaaaacaaaagcaaaataaaagccaaagacaggtgtgaagaagatttctgggagagcgcattttaaagaaggtgggactttcttcatccgagagccacccaacccagcatctcggcgtgggccggcctgtacccctcgtcaaaggaacaattggcttgcaaactgggaatctccgttaaaacggacaagacgattttgctcttttcttgcggcaacgtctgaagatgtgcaagaagggggtctgttttaggccaacctcagccctctctgcgaccctcgagagcttgtgcaaatggcacagctcctgcctggaggctgtgtgtccttttgcagcactctggtgagcccgggttaaaaatcacacaccccaaagggaggctgagctgagggctttctctggcattcagcagcgtctctggcctggatatgccctgctagctggggtatttctgcagagcagcctctcctacccgaacactcccaggtccccgtgacttacaacggtggctgcagggagggcagacgtcctgggtgatgctggtctggtggtgcttgtctgagcagccgtcaagctaggcagggggtcctgggggaccctcctcctgggccagaggcggctgccctatgggagtgagctccgcacaggagcaggagtggagggccagctctctgctctgctgggaaaaaaatcccactggctgtgcctgcaccgcaccttgagacagacaccagcagcctccggagacccagcaagctgctcttagctgcgatctgtcatctgcagactgagcttggtgcatggcggttatgaaactggccagagcaacaatagatggaaaagcttcctctttttggccctgggccccagggagcgaggtcaggtaatccgagggggattttatgtgtttttctcctaatgcggtatttttcaattaggctttaaaaaaaaaaaatgagtttggcctccatgtatgcgggaccattgcctcagaagggttagtttaggattagaaaatgggttaaacttaaggacagcttctcttggatatattggatattactttatgctttatgtgaaaatactaatttttaaaaatatgtatgtccatagtcactatttgttttcttttgagactgagtctcgctctgcctcccaacctggagtgcaatggcaccgtctccgctcactgtcacttcctcctcccaggttcaaatgattctgcctcagcctcccaagtagctgggaagacaggcatacatcaccacacctggctaatttttttttttttttgtattttttttttagtagagacagggtttcatcatgttggtcaggctggtcttgaactcctgacctcaggtgatccacccgcctcggcctcccaaagtgctgggattacgggcatgagccactgcgcccggctgcgtattcactatttaaaagtagtcagtactcattggatgatgctaagacagttttttatttggaagcttgaggctgcagtgagctgaactgcactgtactcactgttcggaactgaattgaactcacaccactgcactccagcctgggtgacagagcaggaccctgtcttaaaaattaaagggagagccctttattacaaacagcgagctcagtatatattttctgagtgttgtgtctgttacaggctgcattgtaccctcccaaattcatacgttaaagtcctaacccctaggaccacacaatgtggctgtatttggaggttacctctttaaagagttaactacagtaaaatgaggtcaccaggagtgggccctgatccaataggaccggtgtcctcataagaagaggagatgaggacacagacacacacagagggacgacactgtgaggacacagggagaagacggcatctccaagcccaggagagaggcctcaggaggaaccagccctgcccatacctggatctcagacctccagcctccaggactgtgggagaatcaatgtttgttgtttctaagctgcccagtctatggtattctgggatagtcgttcgaaatggacaaagacacctcataagaagaggagatgaggacacagacacatacagagagatgaccctgtgaggacacagggagaagacggcgtctccaagcccaggagagaggcctcaggaggaaccagccctgcccatacctggatctcagacctccaccctccaggactgtgggagaatcaatgtctgttgtgtataagccccccagtctacggtattctgtgacagcagcctgagatggactaagacacctcataagaagaggagatgaggacacagacacacacagagagatgaccctgtgaggacacagggagaagtcgatgtctctaagtccacaagagaggcctcaggaggaaccagccctgcccacacctggatctcagacctccagcctccaggactgtgggagaaacaatgtctgttgtttacagtccacccagtttgcagtgttttattacggcggccgagctgactacccatccactctgaagcagttgggagaaggcagacgtcagagatgctgccgaaacctaggctgaatggaagtgaacttgggatgctgctgagacctaggctgaatggacgtcaacttgggtaccactggcttctccctgctgttgaatcccaaagaccatctcgaggccatctggagtcatgctcccccgccagcttctcagtagagacagcacgttacagggtgggaaatggttattcacaattgttcagtggctgcctgccttggcgttggggagccacatgagaaggctcacagccacagccacagccctcccgggtgcgactccctgggatcctgccctctgccctctcagagggtttctctctctctccgctcagttcacaggaagcaacttgtctgcagttcccaaatctacttcttggagcctctgtcctctactattttcctggagggaacaggctgggaaggaaggtggtgtccccttaaaacattcagtcagccgcggcttcagacggagcagtcatttgtaggtaactaggacttgggaagatattcaacactgcttcctgggagttttttttctttctttctttcttttttgtgagatggagtctcactctgtctcccaggttggagtgcagtagcgcgatgtcggctccctgcaacctccgcctccctggttcaagcaattctcctgcctcaggctcccgagtagctgggatgacaggcacccaccgcacctggccaagtatttttaatattagtattttagaaactcagtcactccgctagtaaaccagtatggatagaaatgcaaacatcaggccgggcgtggtggctcacgcctgtaatcccagcactttgggaggccgaggcgggtggatcacttgagatcaggagttcgagaccagtctgatcaacatggtgaaaccctgtctctacttaaaatacaaaaattagccaggcgtggtggtggcgggtgcctgtaatcccagctattcaggagactgaggcaggagaatcacttcaacccgggaggtggaggttgcagtgagctgagatcgcgccactgcactccagcctgggggacagagtgggactccgtctcaaaaaaaaaaaaaaagaaaagaaaaagaaaaaaaagaaactcaaacatcacagagagagatcaatgtttttttttttaaatagcatgttaattagggttttctctttttttttttcaagacaaggtctcactctgtggcccaagctggagtgtaggccgggcacggtggctcacacctgtaatcccagcattttgggaggccgaggtgggcagatcgcctgaggttgggagtttgagaccagcctggccaagacggtgaaaccctgtgtctactaaagatacacaaattagccgggcatggtggcgggtgcctgtaatcccagctactcaggaggccgaggcaggagaatcgcttgaacccgggaggcggaggttgcggtgagccgagaccgtgccacggcactccagcctgggtgacgagtaaactctgtctcaaaataaataaataaataaatagtatgctgacaagcaaatatggccttttctgtttgttattacgcctggcatctccaagaaggtaccggacttgctgaggtgtggagtagcatccaggctggtgagagatggttggtttggggtgcagtggggcggcgaggggcttgttgggaccggcttggaggcctgtgggtgtcagacctgcagcctagcgggtccttgccatccaggaagctgtgagtatttggtttggggcagctgaacccaggaagcaggactgaggaggtaagaagcagagagggatgagcagtacactcccgccgggtgccagccaacagacacggagagcatgaaggataaaaataaaagaccaactgctccctgcgagctgattcctggtttgccctggagactcaagctgctcctgaactttaaacagcacccacagtgtcagaaaactgttgatgaggccgggcgcggtggctcacgcctgtcatcccagcactttgggaggccgaggcgggcagatcgcgaggtcaggagatcaagaccatcctggccaacatgctgaaaccccgtctctactgaaaacacaaaaaattagccgggtgtggtggcgggtgcctgtagtcccagctactcgggaggctgaggcaggagaatggcgtgaacctgggaggcggagcttgcagtgagccgagatcgcgccactgcactccagcctgggcgacagagcgagactctgtctcaaaaaaaaaaaaaaaaaagaaaaagaaagaaaacttgaagagggccagcccatcttggttacagcccacaagaggtgacctcccaacactatgggacctgcaacagccaactctgtattttttttttttcagacggagttttcctcttgtcacccaggctagagtgcagtggcacaatcttggttcactgcaacatctgcctcccaggttcaagcgattctcctgcctcagcctcctgagtagctgggattacaggcacgcgccaccatgcccggctaatttttgtatttttagtaaagatgcggtttcaccatgttgcacaggctgaactcctgatcttgaactcctggtctcgaactcctgatcttgtgatccgccctcctcagcctcccaaagttctgggatgacaggtgcgaaccaccgcacctggccctctgttattttttgagatggagtctcactcttgtcacccaggctggagtgcagtggcacgatcttggctcactgcaacttccgcctcctgagttcaagcgattctcctgcctcagcctcctgagtagctgggattacaggcgcgtgccataatgcctagctaatttttgtatttttagtagagacagggtttcaccatgttgcccaggctgatcttgaactccttatcttgtgatccacccgcctcagccttccaaagtgctgggattacaggcatgagcccctgcacccaaccctctgttttttttctttttctttttcttttcttttttttttttttttttgagacagtttcactcttgtcccccaggctggagtgcaatggcacgatctcggttcagtgaaacctctgcctcccaggttcaagcgattttcctgcctcagcctcctgagtagctgggattacacgaggtgtgtgccaccacgcctggccaatttttatatttttagtagagacggggtttcaccatgttggccaggctgatctcgaactcctgacctcaggtgatcctcctgccttggcccccaaaatgctgggattacagacgtgaaccaccatgcctggtggccctggccttttcttacgcatgaggtaatgcttgccacacctactggttatgttcctgcaaactatcaccagatcgcctcttacgcccaaactttaatgcaatgtttcacgtactatgtatttactgcgtatattaaaactataacttatgggaaatgtgtcattaggtgaaacgtattaataaggaaaaaaaagaaataaaaacaaaacaaaacaaaaaaaccctataatttaaaatactacattcaaacaacctgaccaaaactttctaaatgatttccccaaaacagagccgtaagtaacttgggaacaagacaagaggcaacctgggatgtctttctatttatttatatctctaattttttgaatctgtttttttgttttgttttgttttgttttgtttttctttttgagacggagtctcgctctgtggcccaggctggagtgcagtggtgtgatctcagctcactgcaagctccgcctcccgggttcccgccattctcctgcctcagcctcccgagtagctgggactacaggcgtgtaccaccatgcccagctaattttttgtatttttagtagagacggggtttcaccgtgttagccaggatggtctcgatctcctgacctcatgatccgcctgcctcggcctcccaaagtgctgggatgacaggcgtgagccaccgcgcccggcctgttgttgttttttaatgtttttttttagttttcggtgtacaaatctactttcatgattaatttctaactgttttattctttttggtgttattgttaatgtaattgttttcttattctcttatttatgtacttattttgaggtagggtctcactctgttgcccaggctggagtgcattggcacaatcatggctcacagcagccttgaactcctgggttctagtgatcctcccacctcagcttctcaagtagctgggactacaggcgtgcaccaccatgcccagctaatttttttttttgttttttgagacggagtctcactctgtcatctaggctggagtgcagtggtgtgatctcggctcactgcaacctccgcctcccgagttcaagtgattctcctgcctcagcctcccgagtagctgggattccaggtacacgccaccacacccagctaatttttgtatttttggtagagacggggtttctactaaatgttggccaggctggtctcgaactcctgaccccaggtgatcctccaacctagccctcccaaagtcttgggattacaggcgagaggccctgcgcccggccacgttaattctttagaagtcaacagaggcccattgctctgagccgccgccacccccagccctgtttgtgacgaccaatgggctgccgtggacataggattttgggtgtgctaaaaccaggaaagcccccagcagcacccaggctccgaggttctgggagacacaacctccccgccagagggaaatgacccattacaatcccctgggtggttttccaggccaagcagctggggccgcctgtctggcccagggtggcctgaatctctcggttctgtcctgggagaggtggggatttttaagcctgaccttttaactttaccacagggctgctatccagccttccttcctgtgacagactctacgcccatcttccaaagctcacagagctggccggagagtcccagggccctcttgtgaactacgtcttggaaggaggtggctgtgtcttctcagataccatgtccaggcttacatctgaatgttttcggtccgacttcaagggacgtaaatatcagacccctggaagcactctgtgcatccctgtgacggtgctttgcagacttttggcctgtgtttgactttctgatgcgttttcattttcactttcgtttttctgtatttatttatggagacataaggtcttgctctgttgccccaggctagagtgccatggtgacattatatagctcactgcaacctcaacttcctggcctgaaccgatcctcccacctcagcctcctgagcagctgggaccacaggtgctcaccaccatggctggctaattatttatttttgtagacataggggtctcactatattgccccgtcttagttttcatttttattttttattattattattatttgagacaaagtttcactctgttgcccaggctggagtgcagtggtgcgatcttggctcactgcaacctccatctcccgggttcaagtgattctcctgcctcagcctcccgagtagctgggattacaggcgcgcaccaccacgcccggctaattttttgtatttttagtagagatggggtttcaccgtgttagccaggatggtctcgatatctggaccttgtgatctgcctgtctcggcctcccaaagtgctgggattacaggcatgagccaccacgcccggcgagttttcatttttattgattattattattattttttgagacgaaatctcgctctgtcacccagattggagtgcagcgctgtgatcttgcctcactgcaacctccgcctcccgggttcaaacgattgtcctgcctcggcctcttgaatatctggaactacaggcgtgtgccaccacatccagctcatttttgtattattagtagacacagggttttactgtggtggccaggctggtcttgaactcctgacctcaggtgatccacccacctcggcctctcaaagtgctgggatgacagacgtgagccaccacgcctggcctcatttttctatttggaaataaagtcctgtctaggtttatgaggagtgggaccacatcactgaagatacacgagcaagaacatggatttgcttatctctgttttggtcatgtcctcccggggggcaggggtgggggtggcaaacctcctcccctccctcccccacttcgaacacagagtgagtgttggtgacactcagccagggacaggaccccgctgcgagccaggttcctctttctactgactctctggggaccctgtttgcctcccggcaacacgctttgccgaagagcccctgtgctggctgccacgtgagccgcccctgtccctactctcagcagccttccccacctgcaaacccagatcgagggcctcccatgctgggttggatggtggcccccagagatatgtccgtgtcctgagccctgctatttggggagggggtttcatttggaaaagagggtctttgcagattcattccgttgtggatcttgagagaaaataatcctgcattgtctgggtgggccttaaatgcaatgacaggtgtccttctaagagacaggagaggagacacagacacagaggagaaggccacgtggagacggagacagagcctggaatgacgcggccacaagcccagggatgcctggagcccccaggagctgggagagacaggaaggagcctccggagggaactggatccaattgtaatgggttgaacagcggatcctggaaagatatgtccatatcctagagcccagaacctggaatgagaccttatttggaaataagaactttgcagatttaatgagttaaggatctcaagatgagatactcctggattaggctgggccctaaatccaatgacaggtgccctggtaaaagacagaagaggagacgcagacacagaggagaaggccacgtggagacggagacagagcctggaatgacgcggccacaagcccagggatgcctggagcccccaggagctgggagagacaggaaggaccctcccctagagctccttgagggagcacggacctgagacattttgatctcagacttctggcccccggaactgtaagaaagtaaattcctgttgtcgaactccccagtttgtggcattttttgtgtcagcctcaggggactcacagaaatggctttgtctctgcacccctaaaataattttaatgttactactgaacaagtttgaaagatgcaggcactttctgacatgccacgagctttgttacttaaaatacaactgccagctgggcgtagtggttcacacctgtcatcccagcacttcgggaggccagggcgagcagatcacctgaggtcaggagttcgagaccagcctggccaacgtggtaaaccccgtctctactaaaaatacaaaaattagccaggtgtggtggctcacacctgtaatcccagcactttgggaggccgaggcgggtggatcatctgaggtcaggagttcgagaacagcctggccaatgtggcaaaaccccgtctctgctaaaaatacaaaaattagctgggcatggtggcaggcacctgtagtcccagctaatcaggaggctgaggcaggagaatcacttgaacccgggaggcagaggttgcagtgagctgagatcatgccactgtactccagcctgggtgagacttagtctcaaacaaaacaaaaaacaagaaaaaccaaacacagctgctttgtcgctgttctggaggaactgaatagactgtaatcatgttggtgttttacaggcaattatccacttaaataacctgtaaaggaactgtctttaaagatttgggaattctgctggacgtggtggctcacgcctgtaatcccagcactttgggaggccgaggcgggcggatcatgaggtcaggaattcgagaccagcctgtccaatatgatgaaaccccgtctctactaaaaatacaaaaattagctgggcgtagttgcaggcgcctgtagtcccagctactcgggaggctgaggcaggagaatcgctggaacccgggaggcggaggttgcggtgagccgagatggcgccactgcactccagcctgggcaacagaccaagactctgtgtcaaaaaaaaaaaaagatttgggaattccacatgcttctttgccccccttgaagcttctgtttcaatcttattgcctcctgatgtgatgtagacctggatttgaaagccttttagtggtgaccctgtccacctcatgacagcaaaacagttcatgtgttgaaatttaaacataggtttcacttcctgctaccataaggatcccacgtgctggaaacttccctctgttgaaatgttctctgtggtcaaaactgatcaggctgggtgcagtggctcatgcctgtcatcccagcattttgggagtctgaggcaggtggatcacttgaggttaggagtttgagaccagcctggccaacatggtgaaatcccatctctactaaaaatacaaaattaggtcgggtgttgtggctcacgcctgtaatcccagcactttgggaggctgatgcgggcggatcacctgaggtcaggagttcgaggccagcctggccaacatgctgaaaccctgtctctactaataatacaaaaattagccgggcattggccaggcgtggtggctcacgcctgtcatcccagcactttgggaagccgaggcgggtggatcacaaggtcaggagatcgagaccatcctggctaacacggtgaaaccctgtctctactaaaaaaaatacaaaaataaattagccgggcgtggtggcaggcgcctgtagtcccagctacttgggaggctgaggcaggagaatggcgtgaacccgggaggcagaggttgcagtgagccgagatcgtaccactgcactccagcctgggtgacagagagagactctgtctcaaaaaaaaaaaaaaaaggaagaaaatctcatgctcaacctcaaattggaaacgtgaatcagggcgtctcagaggacctgagctgggtttctgtgactgacgtggtactctggccacttgcccatcacaaaaacggatgagactgtggaaagcagatctttatctttctgagaaggaagcaacagagggcctcgtcaccggcctttccgttggccttggcgtcttaatgaccacagatagtgtccatggactgagtttcctcgtggccagcaaggacagggctgaaaaatggaaccactccacatggaggcactggatgagtgtctgcagacaactgaagatgaagctaggtgtctcatcaacaatttcagaatattatccactagcttcggaagatacaaaaagccttctgggaggccgaggcgggtcgatcacctgaggtcaggagttggagaccagcctggccaacatggtgaaactccatctctactcaaaatataaaacttagctgggtgtggtggcgggcgcctgtcatcccagctactcgggaggctgaggcaggagaatcgcttgaaccagggaggcggaggttgcagtgagccgacatggcgccattgcactccagcttgggcgacagagcaagactgcgtctcaaaaacaaacaaacaataaaacacaaaaaacaaaaaacaaaagaatccaggaggaggacttgcaagtagagtttccatttctacccctgtgtaaaattccttgagtattgcatttttaaaaatcatttcccatttctaaactttgtaacaaaagaatatcttttttacattgaacaaagcatcttaatttctttcttctttttttttttttttttttttttgacacagagtcacactccgtcacccaggctggagtgcagtggcacagtcttggctcactgcaagctccgcctcccgggttcaagtgattctcctgcctcagcctccctagtagctgggattataggcacccgccaccacacctggctaatttttgtatttttagtagagacggggttttgccatgttggccaggctggtctcgaactcctgaccttagacgacccgcctgcctgagcctcccaaactgctgggatgacgggtgtgagccaccatgcctgatgcttaatttccttcttaaaacatgctcccctgtgcccttccccttctaagatgagccaggaggctaattgggtagacaaaagaagacagaagtttgtgtccttctagacagaactggtgtggcccaccaggctatagatggagatgtctcttctgagagaagactgcctctttgtcctttccattgagaaaatgcttccttttcagccctgagctgggggtatcaggagtccaggaaagaaagaaggcagaggagagagagaggtgtttggatgtaaagatgtatctaccacgttgaccagaatcttgacgacatcaccatgagctccgtgactcagagggaccctggacattttggacgtttgtcacttgctggccactttctttctttctttttttttttttgagatggagtcttgctctgtcgcccaggctggagtgcagtggcgcaatcttggctcactacaacctctgcctccctggttgaagtgattcttctgcctcagcctcccgagtacctgggattacaggcacccgccaccacgcccggctaatttttgtatttttagtagagacggggtttcaccgtgttagccaggatggtctcgatctcctgacctcgtgatccgcccacctaggcctcccaaagtgctgggatgacaggcgtgagccaccgcgcccggccactttctggccattttcatttctgtaggcaatggacgggtcctaggagtccatggattcaggggtcctaggagctggccaccaagaataactcagacctggtcaagtctcaaggtatcaggtccctgtttgttcaaatcggagtcctcatgggccccaaagttccgtggtctactgtttccaaaagcctcccgaagcccttgcgtacatgcaacacccccagctgcctctgagcgaagcaaggagggtctaagttcagaggcatgatcagggcaggcgtcctcacttgctctctctgtgcgtgtccaagatgaagtcccctagatttcaccggacgagatgagacctgacattccacattgtccttgaacacctgtcagtcagcacccactacttcctgagtcctggaaatagtcaacctcatctctcgttggatgaggagttgtcccgggagacacgccaggaccccacccaagccttcctagctgaaaatcatcactgagccagaaaagctgtcgctcatatccccggtgaccgccgacggtggttcggagctggggtagctcatgagtccctgcagtactggcgacatacctgttgtgtggattgctaaactgaggctcggggccgtgacggcacccggtcacagcacccggcggagtccccacgtgccggcccctcctgttggcgacgcgcgatttccgcccccctgcctgacttcccatgtctccctgccacattcatgagtagcttcatgttgagtttgagcctgcttctgggtacactacccctgtggtgacgggagggaaagtaaaggtttttctcacttgacagaagaggaaattgaggttagctattaggtcatggcatggccgtggtcagacccacggctgataacatgtaaaggcacgcctgaatcaagccagccccgtctggcactcaacacacaccccacgtctttgcagccgggcgggaccaggcgggacccacaccgccatccctcaggagacctccctgccgcctcccccacctctttcaccccgtatggcgtgtgcctgatgacctctcatcacgatgcccctgtccccccgacgccctgtgggtttgggggaaaaatccagcaatggcctagggcaggtcacataagattcctcacaacagactctgatgttctggcagtattgctgagtgtctctaaaaccatggaaagccccaggggctggcagagctgcaggcagtcagctggggaggtggcgttcatgctgccattaaccaggctgagtgttgatcaaaggttttcaactggggccactgtggtccccaggggacgctgggcagcagcgacatctctggctgtcatgacggggtggaggagctcctggcatctggtgggtgcagcccagggacaccgttcaacacactacactgcacgggacggccctgccacagagtgtcatccagccccaaaatgtcagcagtgctgaggctgagaaactccacatatcggttatccccacatgagagactccttatattggttatctatgtatccatctatgtatctacctatctagccatccatctatttatctctctatctatcatctatgtatctatctgtctagccatctatctatctatccatcatctatgtatctatccatctattcatccatctatctatcctgtatgtatttatctatccatcatccatccatccatccatccattctatctatctatctatctatctatctatctatctatctatctatctatttctattatctatctatcatctatgtatctatgtatctatccatccatgtatgtgtctatcatctatgcatccatccatccatccctccatccatccattcatccatccatccatccatccatccatctattctatcatctatgtatctatgtatccatccattcattgtatctatcatgtatctattatctatctatcctgtatgtatctatccatctattcatccatctgtctatcctgtatgtgttcatccatccatccatccatccatccatccatccatccatttattctatctatgcatctatctatgtatctatctatgtatctatctatgtatctatgtatctatctatctatctatctatctatctatctatctatctatcatctatgtatccatccattctatctatctatctatctatctatctatccatctatgtatctacctatctagccatccatctatttatctctctatcatctatgtatctatctgtctagccatctatctatctatccatcatctatgtatctatccatctattcatccatctatctatcctgtatgtatttatctatccatcatccatccatccatccatccatccatctattctatctatctatctatctatctatctatctatctatctatttctattatctatctatcatctatgtatctatgtatctatccatccatgtatgtgtctatcatctatgcatccatccatccatccctccatccatccattcatccatccatccatccatccatccatccatctattctatcatctatgtatctatgtatccatccattcattgtatctatcatgtatctattatgtatctatcatgtatgtatctatccatctattcatccatctgtctatcctgtatgtgttcatccatccatccatccatccatccatccatccatccatttattctatctatgcatctatgtatctatctatgtatctatctgtctatctatctatctatctatctatctatcatctatgtatccatcctatctatctatctatctatctatctatctatctatctatctctattatctatctatcatctatgtatctatgtatctatccattctatctatctatgtatgtatctatctatcttctctatcatctatgtatctatgtatccatccatctatgtaaatattatctatgcatccatccatccatccatcatctatgtatctatgtatctatccattcattgtatctaccatgtatctaactatcctctatctatcatctatctatctatctcatctatcatctttatacatctatcatctaccacctatctgtctcaatatctgtcaatctgtcatctatatctatgtattacctatctatctcaatagctagctatcaatcatctatcatctaatctattcatccgtctacctcaatatctatcaatcatcgaatagctatatctattcatctatctgtctacacctggcttagagcgtgatggactcactactctgggagagtagctgcgaggaacaccaccagtgtcctcactaatacaagctttttgtttttctctagcagctgaacgagccctggcttggagatgaacaatatgaaaactggtgaagctcgtccagctcacagatgctcactcacggatcccctgctccaccagccataactacaactttgatcgcacaagagattaatttcagccactttctcctggtaagagactctgacaatgggctggttctggatggttgacagaggctgcacactcagtgcctctgtgttctggaagccccttttgacagccaggcgcagtggctcatgcctgtaataccagcactttgggaggctgagatgggtggatcacttgacgtcaggagttcaagaccagcctggcgaccacagtgaaaccctatctctactaaaaacacaaaaattaagccaggcacggtggcgtgcacctgtaatccaagctactcagtaggctgaggcaggagaattgctggaacctgggaggcggaggttgcagtgagccgtgatcgcgtcactgcactccagcctgggcaacagagtgtgactccgtctcaaaaagaaaaagaaaagaggccaggcacagtggctcccgcctgtaatcccaacactttggaaggccaaggcgggtggatcacggggtcaggagattgagaccatcctggctaacacagtgaaaccccgtctctactaaaaaatacaaaaaaattagccagctgtggtggcaggtgcctgtagtcccagctactcaggaggctgaggcaggagaatggcatgaagctggaaggcagaggttgcagtgagccaagatcgcaccactgcactccagcctgggcgacagagtgagactctgtctcaaaaagaaaaagaaaagaaaaaaagaaaacaccttttgatatagacagcctcattggggcacattaaaggttaaaagtctctacccccaagtgaatgtggaacttctgccacaggcatgtttgtcctgtatccacgtgtcaggatgcccttcattaaaattcatagctcctcctgtaacctgttgaatacaagtatgcttggtcatctcattcaacataaattcccatctctgtcttttcttcttcgaaatgtctacttttagtttctgccagaggctacatttcccagcctgttaggctatacaaatcaagctcccctctccaaatgtgtacatcttgtcattttttgtttctttaagcgacgagatctcggtctgtcacctaggctggaatgcagtggtgtgatcacagcccactgcagcctccaactcctgggttcaaactgtcctcccacttcaacctcccaaagcactggggtgaaagacaggagccaccttgcccaaccaatctcgtgattttaagttgacaccttccattctcttgacggcactgagcattgccttcaacggcatgtctacggatggccagctgggtcccttctggggctccagacacgattctcttagctgtctgttgtctgagagttcttcctgattgacacatggcctcctgccttataacttcccccacctgagtcctctcgtctgtcccacatcactcgctgacaacacccacaatggccaggtgtgtccttctggaattccaggtgagcaagtgttctgccttcggtgatatgggggcccacctgttcctctgcctttttttcctagctccttggtccagggctcatcacaccagatatgtaagcaaagagaagaggctcccaggctggcgggggggtctcctgtccagggtctcctgtgtaagagtgtcctggggatatagcaaacaatgaccccacactgggggtacttaaacaacagaaattcatcatctcccagtcctggaggtgaagagtctgagattaaggtgcaggcaggcccacggtattagtctgttctcacgctgctaataaagacatacctggctgggcgcagtggctcaagcctgtaatcccagcgcactgggaggccgaggtgggtggatcacctgaggtcaggcgtttgagaccatcctggccaacatggtgaaaccccatctctactaaaaacacaaaaattagccaggcgtggtggtgggtacctgtcatcccagctactcgggaggctgaagcaggagaatcgcttgaacctgggaggtggaggttgcagtgggctgagatcatgccattgcactccagcctgggcaacagagtgagactccgtctcaaaaaaaaaaaaaaaaaaagagacatacccaagactgggtaatttataaaggaaagaggtttaatggactcacagttccacatggctagggagacctcgcaatcatggcggaaggcaaaggaggagcaaagtcatgtcttacatggtggcaagcaagagaaaaggggaaagtcccctttataaaaccatcagatctcctgagacttatttactctcacaggaacagtatgggagaaaactgcccataaagttcaattatctctgcctggtcctgcccttcacatgtggaaattattattattattattattattatttaattttactttaagttgtgagatacatgtgcagaacctgcaggtttgttgcataggtatccgtatgccatggtggtttgctgcacctgtcaacccattatctaggttttaagccccacatgcattgggtatttgtcctaatgctctccctccccttgcccccccaccccccaacaggccccggtgtgtgatgttcccctccctgtgtctgtgtgttctcattgttcaactcccacttatgagtgagaacatgcggcatttcattttctgttcttgtgttagtttgctgagagtgactttctggctttatccacgtccctgcaaaggatatgaactcatccttttttatgactgcatagtattccatggtgtctatgtgccacttttttttttatccagtctatcattgatgggcatttggattggtcccaagtctttgctattgtaaatagtgctgcaataaacatagacccgtgaagattattacaattccaggtgagatttgggtggggatatagtcaaaccatatcaaccatcctccctgtggaggctctaggggaggatccctcctgcctctccaagctcctgggggctccaggcatccctgggcttgtggccgcatcactccagtgtctgcctctgtctccacgtggccttctcctctgtgtctgtgtctcctcttctgtctcttacaaggacagctgtcattgcattttgggcccactctaatccagaatgatccaatctcaaggtccttaacttaatgacatctgcaaagaccctatttccaaataaggtcttacagactctgagcattaggatatggacaaatgtttctggtggccactattcaatccactacaattgtatccagttccttctgggaggctctaagggaggatccctcctgcctctcccagctcctgggggctccaggcgtccctgggcttgtggccccatcactccagtctctgcctctgtctccccatggcctcctcctctgtgtctgtgtctcctcttctgtctctcagaagtgaacctgtcattggattttgggcccaccctaatccaggatgatctcatcccaaacccttaaatcacatcttcaaagactttttcagcaaacaaagtcctgtttccaggttccagggggttagggcatggtcctatcttttgcaggtacgcaccattgaacccactacacatagcgttaacaacttgtgcccgttttcctttaattgtcccacttttagccctgaggttcttgtgtcctgaaaataccttataaatccagggcaaaccaagatggattatctccccacatccaacacctgcacaggtaagtacaattctgtttaatcttgatgtctgctcaggctggctcttctctctgcctaccacagctgggttctgtgcttggtatggacacccgcccctttcctttccttttcctttcctttccatttctttcctttccttcccttcccttttattttccttttccttttcctttcccttccctcccttcccttccctttcctcccctcccttcccttcccttcctttcccttctcttcccttcccttccctcccttcccctccttttcctttccttttccttttcctttcccttccctcccttcccttccctttcctcccctcccttcccttcccttcctttcccttctcttcccttcccttccctcccttcccttccttttcctttcccttcccttccctttcctcccctcccttcccttccttttcctttcccttcccttccctttcctcccctcccttcccttcccttcctttcccttcccttcccttccttcccttccttcccttccttcccttcccttcccttccttcccttccttcccttccttcccttcccttccctttcctttcctcccctcccttccttttccttcccttcccttcctttcctttccttccctttccctttccttccctttccctttccctccccctccccctccccttcccctgtcttcctctcccctccccttcccctcccctccccttcccttccctttgacagagacttgctctgctgtcctggctgaagtgcggtgacactacctcagctcactgtaacctcagcctccctggttcaagcaattctcctgcctcagcctcccgagtagagtagctgggattacaggcacccaccaccacacccagctaatttttgtatttttagtagagatggggtttcaccatatgttgcccaggctggtctcgaactcctaacctcaaacaatccacccacctcggcctcccaaagtgctgggattacaggcatcagccaccgcgcccaacctgcctttttcttttcttttattattattattttttaaagataaaaacaactttgtagagatagaattcctacagcatgcaattcacccatctacagttcattgggtttagaacgttaagttgtgcaaacacctccgcagtctattttaggatattttctttctttcttttttttttttttgagacagttttgctcttgttgcccaggctggagtgcaatggcacaatctctgctcaccgcaacctccgcctcccaggttcaagcgattcccctgcctcagcttcccgagtagctgggactacaggtgcccgccatcacacccggctaattttgtatttttagaagagatgggatttctccatgttgcccaggctggtctcgaactcctgacctcacgtgatccacccgcctcggcctcccaaagtgctgggattacaggcatcagccactgtacccagccatttaggatattttcatcaccccaaaaagaaatcctataccctctggctcttactcactgctattgtctgaaggtttatatcaccccaaaatatataggtttcaaccctaaacctcagtatgctgtcaggaggtgagagctctgggggagattagggtgggatgagtttacagcagagatgctccatgatgagacaaatttccttataagaacaggaagagggccaggcatgggggctcatgcctgtaatcccagcactttgggaggccgaggggtcggggggtggtggatcacctgaggtcaggagttcgagaccagcctggccaatatggtgaaaccctgtctctactaaaaaaaaaaaaaaaaaatactaaaaattagccaggcgcggtggcaggcacctgtaatcccacctacttgggaggctgaggcaggagaatcgcttgaacctgggaggcggaggttgcagtgagcggaggttgcaccactgcactccagcctgggcaaaaagagtgaaactccacctcagaaaaacaaaacaacaacaaaaaaaaaacaggaagagaccgcagagcatccacgtactccctccttctctccctccctccattcctcccttcttcacccctctcccacaaatataagcacagagaacaaccctgtggggacacagggagaagacggtgtctacaagcccaggagagaggcctcaggaggaaccagccctgcccacacctggatctcagacttccagcctccaggactgtgggagaatcaatgtctgtcgtttctaagccgcccagtctatggtgttctgtgatagcagcctgaaatggactaagagatctcataagaagaggagatgaggacacagacacacacagagggatgatcctgtgaggacacagggagaagatggcgtctccaagtccaggagagaggcctcaggaggaaccagccctgcctacacctggatctcagacctccagctccaggattgtgggagaatcaacgtttgttgtgtataagtcacgcagtctatggtattctgtgatagcagcctgaaatggacgagaacatctcataagaagaggagatgaggacacagacacacacagaggggcgaccctgtgaggacacagggggaagacgtcatctacaagccaaggagagagtcctcaggaggaaccagccctgcccgttcgctgatctcagacttccagcctccagggctgtgggacaatcaatgtctgttgtgtataagccacgcagtctatggtattctgtgttagcagcctgaagtggactaagacacctcataagaagaggagatgaggacacagacacacacagatggacgactctgtgaggacacagggagaaaacagcatctacaagccaaagagacaagccttaggaggaaccacccctgcccacaccttaatcttggatttccagcctccagggctgtgggagaatcaatgtctcttgtttctaagccacccagtctatggtattctgtggtagcagcctgagatggactaagacatctcataagaggaggagatgagggcacagacacacagagagggacgaccccgtgaggacacagggaggagacagcatctacaagcccaggagagaggcctcaggaggaaccagccctgtccacacctgatgtccagcctccaggagaatcaaggtctggcttttaaaccacctcagccttcagcttgggcccccgccccatcccacaaacacccccaaccttgtccgcctctgtgtgccttgtgggcagtccccagtacatggccttagactgctgttccaccctccagagtctcaggatgaactggaaggtattaaggaagtcatctgagggctctgagcaaaatggaaactaatttcagtgggaaaagaggatctgcagtgagtgagtctgttgagctccggcagagaagaagcctggtgtcagggtccttctgcctgagcctgtggggccaggtaatgttaacaggaagcatgctcagacccaagcgaggtctcagaagatttaagggaagttcaatcttcacacgtgtctctggtttccagtaatatctggcccccaatattctccctggtcctcaatattttctggttcttagtaatctctcggccacacgcggtggctcacgcctgtcattccagcgctttaagaggctgaggtgggcagaccacctgaggtcaggagttcgagaccagcctggccaacatggtgaaaccccatctctactaaaaatacaaaaattagctgggcgtggtggtgcgcacctgtaatcccagctactcaggaggctgaggcgggagaattgcttgaacctgggaggcggaggttgcagtgagccgagattttgtcactgcactccagcctgggcaacaacagcgaaactccatctcaaaaaaaaataaaaaaataaataaaaataatcttggccgggcgcggtggctcacgcccgtcatctcagcactttgggaggctgagatgggtggatcacctgaggtcaggagttcgagaccatcctggccaacatggtgaaaccccgtctctactaaaaatacaaaaattagccaggcatggtggcaggtgcctgcaatcccagctactcgggaggctgaggcaggagaatggcgtgaacccaggaggcggagcttgcagtgagctgagactgtgccactgcactccagcgtgggtgacagagcgagactccgtctcaaaaaaaaaaaaataataataatataataaaatattaaatatttaatatatataataaaaaataataatctctctggtctgtaatattctctgattccccaaaagctccctagtcccccaaaacctgtctgtttccccaaaatctttctggtctttaatattcttgctgggcccaatggtctccctgatcctcaatatccttgctgggccctgatcatcttgtttgtccccaatcttctctctggttccctaaaatctctccagtcccctcaaatctgtttggttctccctggccgccaatattctctctaatcctcaatattctctgtggttcacaataatctttccagtctccagtattctttctggttccccaaaatctttctagtcccccaaatcctgcctaactcccaaagcctgtctaatttccaatacttccattaagccccaatattttatctggtctgcaataatcttcctgatccccaatcatctccttggcccccaataatcttcctgcccccagtaatctccctggtcctcagtattttctcagatccccaatattctctgtggtccccaatcatctccttggtccctaatctctctggtccccagtaatatttctgatccccaatattcctctggtccccaataatctttcggctccccaatattctctctgatccccaatcatctccttggtccctaataatctctctggtccccaatcacctccctgatccccagtaatctctgagatctcaatattctctctgagcctcaatattctctctgagtctcaatgttctctcttgtccccaataatctctctggtccctaataatctccctgctccccaatattctctccgatctccaattatctccttggtccctaataatctctctggtctccaatcatctttctgattccaatattctctctggtccccaatattctctctggtccccaataatctccctgctccccaatattctctctgatctccaataatatctctgatcccaatattctctctggttcccaataatctctctggtccccaatcatctttctgattcccagtaatctctctggtcccaatattctctctggtccccagtcatctccttggtctccaatattctctccaatttctaatattgtctctaatccccaattatcttcttggctcccaatcacctccctggtttctaatattatctctgttccccaatattctctctgatccacaatcatccccttggtccctaatcatctctctggttaccaatcatctccctggtccccaagattttctctgatttctaatattgtctctgatctcccccaaatctccctagttcccaatattttctcggatccccaatcatatacttggtccctaataatctccctgatccccatcatcttcttgatctctaataatctctctggtccccaaaaatctccctggttcccaatagtctctctggtccccaatcatctctctggtccccaataatctctctggtccccaatattttctctgatctccaattatcaccttggtccctaataatctctctggtcctcaatcatctctctctggtccccaataatctctctggtccccaatattctctctgatctccaattatcaccttggtccctaataatctctggtccctaatcatctttctgacccccaataatctctgtggtccccaatattctctgtgctcctcaattatgtccttggtccctaataatctgtctggtccccaatcatctttctgatccccaataatctctctgatcccaatattctctctggtccccagtcatctgcttggtctccaatattctctctgatctctaatattgtctctagtcctcaatcatcttcttaaccccaataatgtccctggtttccaacattatctctggtcccaagtattctctctgatccccaatcatctcctcggtctctaataatctctctggtccccaatattctctctggtccccaatcatcttcttagcctctaataatctccctgatccccaatattctctctggtccccaatcatctctctgatccccaataatctctctgatccccaatattatctccgatcctcaattatctcattggtccctaataatttctctggtccccaatcctctccctgatccccaataatctctctgatcccaatattctctctgatcctcagtcatctctttgttctctaataatctccctggtctccaatattctgtctgatttctaatattatctctggtcctcaatcatcttcttgtctcccaataatctccctgatccccaataatctccctcatcctcaatattttctctgatttctaatattgtctctggtccccaataatctccatagtacccccaaatgtccctggttcccaataatttcccttgtccccaataatctccttgatccccaatcatctccttggtacctaattatcttcctggtccccaatcacctctttggcccccaatcatctccttggcccccaatcatcaccctgctccccaatatcctctctgatttttcttttctttttttttttttttttttgagacagagtctcacactgtcgccaggctggactgcagcggtgcgatctgagctcactgcagcctccaactctctggttcaagggattctcctgccttagcctcctgagtagctgggattacagagctgggtttacaggcatgctccaccacgtccagctaatttttgtattttagtagagacggagtttcactatattggccaggatggtctccatctcctgacctcgtcatccgcccgccttggcctcccaaagtgctgggattacaggcatgagccaccgcgcccggcctttatcctctctgatttctaatattctctctgtccccaataatatctctggtccccaatattctctctgatccatcacccctctcttatggtccactgtaatccttatgctccactttaatccgtcccagtatggacaaaccctaagatcattgagtacccagcatggaacacggcttgcaaccactgtcaccctggcatcagcaggaaccttggcatcaaagtcacaggccggaggacactctgcatttgtctgcaggaagtcaattcacttggaccctgcctgcaggaatgtggaccgtcagtcatttgcatgagtgcttagaaacggcaaaggaaggtgtgtttacttagaagtgagttgcatggggtgaaggaagccagtcagccgcacctcagctgggtatttggtggtatttggtggaggtttcagaaactccccttcctttgcttccggtgagcgtgacggacaacctcctaattcctgtgcagcccgaaaagggtcccgcgaagagtgtttatagcccagaatgaggaagtgagacaaggggtattgcatggttattttttcttatgtctttctctttctctctcgctctctttttttttttttttttttttttttgagatggagttttgctcttgctgcccaggctggagtgcaatggtgcgatctcggctcaccgcaacctccgcctcccgggttcaggtgattctcctgcctcagcctcccgagtagctgggattacaggcatgcaccaccatgcccagctaattttttgtatttttagtagagacgggggtttcaccatgttagccaggctagtctcgaacccctgacctcaggtgatccacccgcctcaacctcccaaagtgctgggatgacaggcgtgagccaccatgccccgccctctttttctcgcttaaaaaaaaaaaggtgaggtttacataatgaaatcaatcattgtaaacggaatacctcagggggatttattgcattcatgcctccgtgcagccaatacctcgatgtagtttcagaatattttcctcacctcccacacacgtgtgtattgtaactttaaatgcaatcctcagatgacaaggctcggaatcgtcgtgcacgcacagagattcaacaaccaagatgcgataattatagtacactggccaggcacgttgtctcatgcctctagtcccagcaccttgggaggccaaggcaggagagtggcttcaggccaggagttcaagatgagcctaggcaacatagcaagacactttcattagccgggcgtggtcagtgcctgtaatcccagctacttgggaggctgaggtggaaggattgcttgaggccaggagttagaggctgcagtgagctatgatgaagtcactgcactccagcctgggcaacagagcaagactctgcccctaaaaataaaaattaaggccgggcgtggtggctcacacctgttatcgcagcactttgggaggctaagacaggcggatcactcgaggtcaagagttcgagaccagcctgtccaatatggcgaaaccccatctctactaaaaatacaaacattagctgggcatggtgccacatgcctataatcccagctactcgggaggctgaggcaggagagtcacttgaacccgggaggcagaggttgcagaaagccgagattgcactactgcactccagcctgggcgacagagagagactccatcccccactgccaaaaataaataaataaataaataaataaataaataaataaataaaacaaaaattgaaaaaaataaaaaaaagatatagcaaatagtttggagtagcagttaagggtgtgacctttgtggctggtgcagttggaggtaatgccccagccaggtgagggtgtgccttcctttctgtgtccctcagtttcccctaagcaaaatggggatgtcagcagagctttctcaaagggtgtcactttagtccctaaaatcttccctgttccccaatattctccctggtacctaatcgtctccttggtccctaatcatctccctggtccccaatattctctgagtttcacaattcttgcatttagcatagaatttttgaggttcatccatattgtagcggtatcaatactttcttcccatttaggctgaaaaatattgcagatttgtgattgccagagggaggagggaagggagaagtgggagcgattgcaaataggtacaggtctccttctgagcgtcataaaaatgtattggaagtacacagaggtgatgattgtacaacactctgaacgagctaaataccactgcgttgtattgaagatggtaaatttattattattattatttatttcttgagacggagcctccctctgtcgtccagcctggagtgcagtggcacgatctgtgttcatcacaacttccgcctcccgggttcaagcgattctcctgcctcagcctccccagtagctgggattataggtgccgcaccaccacgcccggctaattttgtatttttagtagagacaggatttcactaaaaaaccctgttggccaggctggtctggaactcctgacctcaagtgacccacctgccttggcctcccaaagagctgggattacaggcatgagccactgtgcccggcaaagatggtgaattttgttatgtgaatttcacctcaataaattaaaacaaataaaacagcagtatttattttggtgactgagttttttggcattggagtgtctacacgtctccccgtaaccccgttcctgtttgattttctcatctgcaatgtagcgatggggtagaattgggtcttgtactcagggttgtttcaagagtttgatggtgtggggggagcattgagaatgtccctttgtacacagtaggcttgtcacacttgccagctgcttacccccctctcttctgcggatccactcatccctttattcactcattcatccgctcattcattcctcatccatccatgcatccatccattcatccatccatccatccatccactcatccatccatccatccatccctccatccatgcatgcatccatccatccatccatccatccatccattcatccatctatccatccatccatccatccattcatccactcatccatccatacatccacgcatccatccatccatccatccatccattcatccatccatccatccatccatgcatgcatccatccatccatccatccatccatccatccatccattcatccatctatccatccatccatccattcatccatccatccatccatacatccatccatccatccatccattcatccatccatccatccatccatccatccatccatccactcatccattcatccatccatccatacatccatgcatccatccatccatccatccatccatccatccatccatccactcatccattcatccatccactcatccatccatccatccatccatccatccatccatccatccatccactcatccattcaaccatccactcatccatccatccatctatccatccatccatccatccatccatccatccacccacccatccatccactcattcattcacctgtctacagtgagggtctgtgtccattcagctgctcaagaaggtggtctcagggtgggggcagcttcttcaccctctcatagtcctgtagccagggtctgtcaccttgcagggagttgtgctccacagcagtgcagagggtttgagtggggaccccccaaaatccctattggtgcaataaatcctctctcctcctctgattaggccaaggagctcagtgttttgtgaagaatttgtttggagagtgttttgagttggattgcatccctttgaaagacacattcaaagcctcaacataggtacctgtgaatataggaccttatttggaaataggatctttgcagatgggattaaggtgtaagttaggatgacatcatactgcatttgggtggggacttaatcctatgggactggggtccttctaagaagagactgggacgcagacatgcacagagggaagattgctgtgtgaagacagaggcagagattggagggaggcattcccaagcccagggacgtcaaggatggcagaggatcagaagctggagagacgcaggaaagattctccccaaagcctcagaaacagtatgcattaattcggggcaattgactggaaatcagctcctttcttgtttcatccgtctattcacctattgactcaatcatgcatccatccattcatccattcatccatccatccacccatgaattcatttatccatgtatgtattcatgcatccattcattcactcattcatttatccatcggttcattcatccactcactcattccttatccatccactcatccatccatctgtccatccatccatccatccatttatccatacatccactattcattcgcccattcatttattcatgcatccattcattcactcattcatctattcattcattcatttattccttatccatccactcatccatccttccattcatccatccatccatccattcagtcatccatccacttatcaatacacccactattcactcacccattcatttattcatgcatccattcactcactcattcatttattcattcattccttatccagccgctcatccatccatctattcatccatccatccatctactcagtcatccatccatttatcaatacacccactattcagacacccattcatttattcatgaatccattcgttcactcattcattcattcattcatccactcattcattccttatccatccactcatccatccatctgttcatccatccatccatttatccatacatccactattcattcacccattctttcatgcatccattcattcactcattcattcattccttatccagccgctcatccacccatccattcattcatccatccatccatctactcagtcatccatccatttatcaatacacccactattcactcacccattcatttattcatgcatccattcattcattcattcattcattcgctcatttattccttatccagccactcatccatccatccatttatccatccatccatccattcagtcatccatgcatggatggatggatgcatccaccactcatccatccaaaactcactcattcatccattcattcatttatgcctttaatcattcacccatttattcagtaattcatttatgcatccactcatttatccactcattcattccttatccatccacttattcagcattcatccatccatccatccatccaattcatccatctatccatctatacagccatctactcattcattcatccatttacttactcatccatccattaattcatttatccatgtgtttattcatgcatcgatgaattcactcattcatttacccacgcattcattcagcatctatttattcactaaatcatttattcatctattcattcatttcttttcttttcttttctttttgagaccgagtttcactcctgttgcccaggctgatgtgcaacagctcgatcttggctcattgcaacatctgcctcccgggttcaagggattctcctgcctcagcctcccaagtagctgggattacaggcgcccactaccacgcctggctaatttttgtattttttagtagagacggggtttcaccacgctggccaggctggtcttaaattcctgacctcaggtgatccgcctacctcagactcccaaagtgctgggattacaggcgtgagccaccgcgcccagcctattcattcatttcttatccatccacctacctatccatctgttcatccgtccatctatttattcattcatctactcattcattcattcatccacttattcattccttatccatccactcatctatccatccatccatccatccgtttatccatccacttatccatacatccactattcatttgcccattcatttattcatgatccattcattcactcattcatttatctattcattcattcatttattccttatccatccactcatccatccatccgttcatccttcaatccatccattcagtcatccacccatttatcaatacacccactatcattcacccattcatgtatctattcattcaatcatttattccttattcatccacctatctatccatctgttcatccatccatccatttattcattcatctactcattcattcatccatccaatcatcccttcattcattcattcatccactcattcattccttatccatttactcatctatccatccatccatccatccatccattcatccattcatccactcttcattcacctgtctacatatccatccatccactcactaatgtactaatccactcattcactcattcattcatttattcattcacccatctatttatgcagccatccattcaaccatccaacaaacagtactgaggccatgttaatctattctggtctctcatctacaaagtcacagcccctacagggaccctgctcattcattccctgtggctgagactgaaggggtatctcctgtttctattccacgtgtggccacctgctggtctgtccctgtcctgagtgcaggagtagtctcattctcctccaccccaagaacagatgagtgataaataaatacctggagacagaatgcctccaaccccagggtaatagcctgagtatcctagaagtttcctgtgttcatgccaagagcttgtgatggacatatggacactgtagatggacaacagcgccttcactgagcagctagtgcctgggaggcctccagcttcactgagcctcaggtttcatctattgcatctcacagagaggctgtctgcaacatgcccatttcaaccactggctgagaggctcatgcaggtatgcatgtgacagggctccttgctggagagtgggttcctggagattccatcagagctactgctgcacaactgccccttgaggaggccatcacagctctgagcagcaggcgctgccagtcagcaccgtgtgaactcaaagtcttgcattcatcctcatacgacatcttcaaaaccactttaaacgtcccagggaagcccggaggagcaagtgcttccaagaggctggctctggtctttggattgagtgtggatttgagtctctttgaatgagtgtggatttgagtttctttgaatgagtgtggatttgagtctctttgaatgcgtgtgggtttgagcctctttgaatgattgtggacttgagtctctttgaatgagtgtggatttgagtctctttgaattcgtgtaggtttgagtctctgaatgagtggacttgagtctgtttgaatgagtatggatttgagtctctttgattgcgtgtgggtttgagtctctttgaatgagtgtggatttgagtctctttgaatgagtgtggacttgagtctctttgaatgagttggatttgagtctctttgagtgtggattggagtctctgaatgtgcgtggatttgagtctcctcattcctgcactttttcagttccctttgttgcatgggacagtataaatgacgctccccattgatccagttttgcaagtaaaaatgtcacatgtggaagccagcatttagtcctcgggcagataagcatgtttgatgagaataacacgtacacacagcggggcccttggtcttggaaaggtggagaataaatcctccatttcccctgagacctgacctgcacagggaatatctgcttaatctacacatgtgtggcttgtaacgacagagtctcttcaattctacttactttattatagtaacaagagcatgcatacagcacattgggagatggagaaatggaaggaagtgatccagagtcccttgacccagcccattctctccctgagacctgggggatgggacatgatcttgcttctccttccaggtctctggaaggatcatcttgtcttatcttgcctgcctctcaccctgtggttcagaattgcgggagattctgttccagtggggatgcttgtctatatcttgggcagtttggggtgtcacaactggagggtgtactcctggggcgtggtgggtggagcctgggaagatgctcagtgccctgcagtgcacaggataggctcaacacagagaatcctccagccctacatggcagcagtgctgaggctgacaccctgcctgagcatgagagagtctctgttagtgactatctatccatctatatctatctatcatatctatcatttatcaatttatctatatatcatatctagctctctggcacctatatctatttatttattaatcttctctgtctgtcatctatctatacctttctagcatttatctctcatctctatcatttatctgcctaccatttgacagtggtttcaactaggggtgatttttctcatcacggcacactgggtaatgtctgaggacagttctggttgtcgcaactgtgggggtgctcctggcatctggtgggtggatcccggggatgcttctcaataccttacactgcacaggatggccccaccacagagaatcacccggccccaaatgtctatagtgttgacgtggaaagatcctgcttttagtatagagaatctctcctctctctctctctctccgtcatccatctatgtatccatgtatctatgtatctatgcatctatgtatgtatgtatgtatgtatgtatgtatgatctatctatctatctatctatctatctatctatctatctatctatctatctatctatgtatccatgtatctatgtatgtatctatctatctctattacctatcatcaccattatctatctatctatctatctatctatctatctatctatctgtcatctatctatatgtatgtacatatctatctatcttatctattgctcatctatctaggtatctctctaatctatcatctatctctctaatctattaatgcacctatgtatgtatctatgtatctatctatctaatctatttatccatgtatgtatgtatgtatctacctatctaatctatgtatgtatgtatatatgtatctaatttatgtacgtacatatgtatgtatctattctatctatgtatctatctatctgattgatctatctctctatcatcaccattatctatctatatgtatgtgtgtatctatctatcctatctatctatctctcatctatctatgtatctctctaatctatcatctatttaatctatgcatctatatatctatctatctaatctatttatccatgtatgtatgtatctatctaatctatgtatgtatatatctatctaatttacgtatgtatcttttctatctatctctattatctatatatctatctgtctatcatcaccattatctatctatatctatgtatgtattgtctattctatctctcatctatctatatatctctttaatctatcatctatctatctaatctatgcatgtatctatgtatctatctatctaatctatttatccatgtatgtatgtatgtatgtacctatctaatttatgtatgtatgtatatatctatctattctatgtatctatttatcgattctatctatctgtctgtctgtctgtctatctatctatctatctatctatctatctaatttgtcacccatctatctttaagacagtgatagatgagcaagtgattttgctacctggagacattgagtaatatctggagacatttctgattgtcacaactgtgggtgctcctggcaccttgtggctggagcccagggacgctgctctacaccctacaatccccaggatggccccaccacagggaattcccccgccccaaatgtcactagtgctccagcagacagcctgtgccttttgtgtctcatgaatggttctatcccaagatctgtccttgccccatcttcctgcatgccctctccatcaggggtccccctgcttacagggtcccccgtaaacaatgtccaggccccctcccagcctgactgtgcccagcccgaggggttagcatgctcagcccacccccagctcatgaactcctggggagcctggacagcacattgccattccaccaactcatcatccgaaaccaacacagcctggcacctgccacctgcttctgtctgtgccactccctgcccagccatggagagtctcataggactcctccctcccatggagaccttcttggctagaaaatcacacatcctgcttccacaaagtccctctgctcagggcaccagcacctttcccctggagcagggcactctgcacaaaagcatcaacgcagtcctcaaggtcccagcccggctcagcggcatgaaaacacgctcaacatcacgaatgatcagggaaatgcaaatcaaaagcagaatgtgacatcacctcactcctgcaagaatggccacaatcaaaacatcaagaaatagcaaatgctagtgtggatgtggcgaacagggaacacgtctgcactgctggtgggaacgtaaactagtacagccactatagaagacagtgtggagagtccttaaagagctaaatgtagaactaccatttgatccagcaatcccactgctgggtatctaggtagaggaaagtaactcattatatgaaaaagatacttagaggaaagtaactcattatacgaaaaagatacttgcacaggcatgtttatagcagcacaatttgcaattgcaaaaatgtggaaccaacccaaatgcccatcaatcaacaggtggataaagaaactgtggtgtatttatatatataaatgccggcactgacacacacacaaacacacacacatatatgtcatatatatgtgtgccatatatatacacacacgtatatatacacatatatgtatatgatgtgtatatatacacatatacgtatatgatgtgtgtatatgcacatatatgtatatatgtatatgatgtgtatatatacacatatatgtatatatgtatatgtgtatatatacacatatatgtatagatgtatatgtgtatatatacacatatatgtatagatgtatatgatgtgtatatatatatacatatacttatgatggaatactactcagtcatgaaaaagaatagcatttggagtggcctggatgagattggagactattattctaagtgaagtaactcaggaatggaaacccaaacatcgtatgttctcactcataagtgagagctaagctatgaggatgcaaaggcataagaatgccacaacggccggatgcggtggctcacacctgtcatcccagcactttgggaggtcgaggtgggcagatcacaaggtcaggagtttgagaccagcctggccaatatggtgaaaccccgtctctactaaaaatacaaaaattaaccgggtgtggtggcacatgcgtgtaatcccagttactcaggaggaggctgaggcaggagaatcgcttgaatccgggagaaggaggttgcagtgagccgagatcgcgccactgctctccagcctgggcaacagagtgaaactctgtctcaaaaaaaaaaaaaaaaaaaaaaacgaaagaaagaaaaaagaaaaaaaaaggaatgacacaaaggactttgggaactccagggcaaagattggggagaggatgagggataaaaggccacaaaccgggttcagtgtatactgcttgggtgacggataccctgaaatctcacacatcaccactaaagaacttcctcgtgtaaccaaatggcacgtgtttccccaaaacctatggaagtaaaaagtgtaaaacaaaccaacaaaaacacacatcagcttctgaaaaaatcttctgaggagtgtgctttcttgaggcaaataaaagagattgccaaaaataatatatatatattcatatattacatatttacatatttattatttaaacatatatttatgtattttttattatttatatattatatatttatatatttattatttaaatatattgtatatttatatattatttattctttatatcttatatacttatatatttattatttaaatgtattgtatatttatattttatttattatttatatattatatacttatatatttattatttaaatatattatatacttatatatttattatttaaatatattatatatttatatattattatttacatatttattatttacatatttattatttaaatatattttatatttatatattatttatatattatatacttatatattcattatttaaatatattattcatatattatttattatttatatattatatacttatatatttattatttaaatatactatatattcatatattatttattatttatatattatatacttatatttatttaaatatattatgtatttatatattatttattatttatatattatatacttatatatgtattatttaaatatattatatattcatatattatttattatttacatattacatagttatatatttataacttaaatatattatatatttatatattatttatatattacatatttacatatattatatacttatctatttattatttacatatatatttgtatattatttatatataatatatttacatatatatttatatataatatatttacatatattatatatttatatatatttacatatatatttatatacaatatatttacatatattatatatttatatatatttacatatatatttatatacttactatttatatattatatattatttatatataattatttatataattatatatgtaatacatatatatatacacacacacagataggtgtatctgttgctttatcctaagtgaacacagatactgcatcactagggagcgacattgtgaaccgcagaacactccctgcagtcccctgagctcagtctggtccttgggggtgatcctgggggcacccatcacgcccacgccctttccgtaccttaacaggtgtaggcagggtgttgtgtgtctcccaggggccgtgcagaatctcctaacccgagagaggaagagcagggttccaggtggacactgggatccctggaccctgccccgcccaccccactgcctctagggacagaagaggggctgggggagggaggttggggaccatgcccagacacagccaatgaggaggtcctgatggagaggcagggctgaaggagagggcgcaggagagagactcagacgagagggggccatctgcccggggaaagggcctctccaagcgcagggctgtacgtatgcaccactggcaacagctaccctgctgttgttaatcctaagccatcgcttcttccctggaactttaagggacaaactcagaactgcagtgtgggtagggttggagggagggagcgtctctgtggttctccaaggggacctcacctctcccacccaccccaaggttggtcagtctgaatggtgcagccaggcggggacctggcagaaggcatctgaaaagcatgtgcttttacaaacacagggttgcccaccgtcccgtacgtcccatgcacgcctctctcagcctctgacctaattgtcctcttgtggggtgggggaggccaatatttgggaaaaggggcagcatcctggtgcacgtaggacgctggcacctgtctggcagtgcctaaatgaaagtactgcttttccaatgtgggataattcctttttttttttttttttttttgagacagagtctcactctgtcacccaggctggagtgcagtggcgcgatcttggctcaccgcaacctccgcctcctgggttcaagtgattctgctgccttagcgtgccgagtaactgggatgacaggtgcccgccgccacactcggctaattttggtatttttagtagagacggggtttcactatgttggccaggctggtctcaaacccctgacctcaagtgatccacccacctcggcctcccaaagtgctgggattacaggcgtctgtcaccgccgtaaacacaaaatatgctactatctggcgctgcttgccaaagtcaagtgggctatgcaaggaggaacggaacgggaaggagagattgaacggcgcagtcaggtgcacctgcttccccacgggcttcagctcctcagcggttttcacttagggctctcgcgcttcagacttctcatccacgttacgtaaagataacaacatgggaagaaacaaccacacacacacacacacacacagacacacacacagacacacacacacacacacacacaaacccttttctttttgggaacagagccacgtgaccatggttcccctttatagaaatgggacctaaagcgccacagcaggccttgttgtgtgtggcctgaaattcccagagcagctccctctgccttttctcagctttttaggggacagatctgacaagacccaaggaattggggtttctaagcggacctgtacaaatgaggtctgaggtggccgtgagacccgggtctggggtctccctggcaccgagggggtgacgaggggccaccgtgctcatccaggcacccatagggctttaaaacccgtttaatttatgcttactcttccattattggaacgctaagcatttgggagttatttatatcccacggctcaaggtcatcgccaaggtctcattgcaaacattgaaaaaactgcaatctcaggcgtaaatgggttacgtgcagcagccgcagctgcttaccctctctaaggttaacctcaagagaggcgcatttcatggaatgagtttttttttgtttttttttttctaaacagagtctcgctctgtcgcccaggctggagtgcagtggcgtgatctctgctcactgcaagctccacctccagggatcatgccattctcctgcctcagcctcccgagtagctgggaccgcaggcgcccaccaccaagcccagctaatttttgtatttttagtagagacggggtttcaccgtgttagccaggatggtctcgaactcctgacctcagatgatccacccacctcggtcccccaaagtgctgggattacaggcacctgccaccacgcctggctaatttttgtatttttagtagagacggggtttcaccgtgttagccaggatggtctcgaactcctgacctcgtgatccgcccacctcggcctctgaaagttcatggaatgagttattaaaggaagggtggcttgcagccctggaaaatttgagcatttctcccctaagtgacgaagcggctgtgcaaagtcttcctcccaggaaatttgcactcctggtctgctctagcgtgaggagaacacgcctcatggagtttgcaccgtcttcccccatgttctcaccgtacacggaccctcccagcgaccctgtcttctcccttgacagtgcaggacaagcataaaagtccagctcggcggctcacctgtgcagaagcagcggcagaagtagcaggtgagagctcagagggtctccaggtaacaggatgcaacgcttaagtcgacggccgtgcctcagagcccgggactcggggggccagccaccagcttgcaagccgtggtcactcaaagtgcttgagaaggtgttcgtgggcggcagacggctgcccttccagttccatctgtccagcaaccttgcaaaggcggccgc

SEQ ID NO: 192 - DNA, 49769 bp, Homo sapiens
cacccgcgcgccccgcccgcgggcggaagctggagcgaggctgaacgcctgacgtcaaggcgacatcgccaaacctcgcccagattcaggcgtgtaaaccagccggagcggcgcggcagcggcaggaccgccgtggcgcctagagtagcgacccggggggagcgcggggcgacgctggctgcagggacccggtgacagcgtgagaggttcgcagagtgagtgcgtggccgctgagggaagccgcggcggcggccgcgcggggccgggcgccggctgaggggagcgggtggggtgcggcgaggcgcgggccgggcgcggcggtcaggggccccggcggcggcagcccctcggcgcgcggcaggtggcgcgagggccaggcgccgggcccgcgagcgcgctgccttgcgggccggcgaggaggagcagccgccgccgccgcgggagaacagcgcgctttgcggaaggggtcaaatgtctgaaatatggcggaggaagtgagagcccgaggacccccccacccgcccgctctcttcagcccgcgtccgccgcagcttctcccgccgccctcctttccccgccggctcccccgaagactcgctccccgccccgagccccctcgcttgtcgcctgggttccctccgtggtatgggtggaagttagaacggaaaccagaaagttgtcctttgcgaagacctagcttctcccagccccgagctagggcgaggagccttcgggggaaaccactcccaggcgccccgcgggcttgagcctgacagcgaaaaagtttgcctgaaacggggcttgcttgctccatttgttgcgggaagtggcaggaggaaggcagcggagagagccccacttagtctggcagcagccaccgtgtagagaaaaactgttaaaggggcctttcccttcgtcagcaagaggaaatctctttctcttagagggagagaaaatccaggaagtttgtcctcttctctttttcgccatctcgaggtgtctaatcctaaaactatcagcgccatgaattttatttaaaactacgcccagtgaaccgggctctccggatttttcttctgaaaaacactgatgtcttttggagaaaagatcatttttgcaagttaaagcagatggtttccttccccttcgctttcccccctctcccactctctttaatagtttagaaaaacattttggccctgtaacttctgattggtatgaatagaagcagttctgtgttgcagtaaggggaaatcacatttttacggggtagaaagttgacactaaatgaagattgtgattttagtattttaaaattaattccgtctaattggattttggttttgcaggcagcatctcatatatgtcgagtacttaacaatttaaagctctgacttgtaaatttatttttcagctctcttttttcgtaattagaatactgtttggacttgctcaacaagaccttatcttaacaaaaagtaacttatagaaaagggagacattcatttaacttcaagcccatattattcttaaaagctgactcttgaaatagtatttattgagtcatagtggagtcatgggactttttaagggccggaagggactatttagatcatccagtcccaccctgtcattttatggaggaggaaactgaggcctagataagataaccagttagtgggtccactgacctttaggacagtagtctatccgtaagagacaacatggagaaagaaatacaacgtttttatagtgaattatcatcttacaaagaatattcttcccatatcgcacttttaaaaagtgggtaccttagtcaaataggagaaaaaaccacttgagtagtttcatcctcaggttttaggtgaggaaactgatactcagattaaataactttaagcacacagagcctgaatgatagtcttatttgagctcatctgtgcttttaatgtgtactacgttaggtgttttcacttgcatttcctttagtcttatttgagctcatctgtgcttttaatgtgtactacgttaggtgttttcacttgcatttccttgtttgacgttgacaataaatcgtgaagctgccttatctaaggaagtcctaaagtaaatcattggaacacatgtagccagtttgttgtttttaatatgccaggtatcaaaatataactgaagaaccaatgctaaactgacttaattttaaaatgttgtatggggcatgaaaatgattgctctggctgggcgtggtggtttacgcctgtaatcccagcactttgggaggccgagccgaggaaggcggatcatttgaggtgaagagttcgagaacagcctgggcaacatggtgaaaccccgtctttactaaaaatacaaaacatagccgggtgtagtggcacgcgcctgcaatcccagctattcgggaggctgaggcacgagaatatgaacctgggaggttcacattgaatgaaccagcttgaacctgggaggcggagggtgcagtgagccgagactgcactactgtactgcagcctgggtgacagagctagacctgtcttaaaaaaaaaaaaaaaaaaaggagataagaaaatgattgctctgctctcttttacattctcccctcacccacgaccgcgtgaaagtcatctctcttaccttctatgacacgcattacttcctgcctcctgttaccattttatattatttattccattgaattgtgaactccaaccacaagatatatattgttttgtatgccttaacgcactggcatggtgccttgcaatagacattcaacaccagttaaatgtaagtaccatgagggtagggacttaatccatttcattcttcacagtaatcttcctagcgcgttgcctgggcacagtgtagcgcgttgcctgggcacagtgtaatggttagcgtttgaatttagggattaatggtaatgaacattcaaagagaggatatttgaagagaacagtgtaatcctttaaaaagaaacatttacatattggctttggaatcccttttacttgacaaattaattttcgttttatcctcaatccttttcagaattccaatattttctcttagctgtataaaggtaaagtgaccccctcccataataaagagctaccatgtaaggagggtatagcaaagaattaattattaaaataactagatccatttttgtaaggatcctttcaattgtatcttcctatctaattcaagattggtggaaggtctatgcaaagattgataacatggtaactgattagacatgttattttaaatgcagtccaagatttggatgaaaagctcacgttcaggttttttttgccttttgttgtaggtactcgataaatatttattgaggtagtgaaactaatctgaaattggatctgatacagagaatttgaccgattttacaaggtgtccatttactttttccccataagtattgtttaaataggctgttttattatcgactatcacacagatcttactgatttgcctcatttccttaaagatgtaaaataactgtgtttctctgtatgtttgtgttgctaaagaggaggttgggtattgatctgcagtttctagatttgactggcactaggagtaatttagcatttatgaattagctatttactgctgttttatagcagtgatgtcacgtgttcactctatagaaaagttaggtaaagattggtctgtcttaaactttctgagacataggttgtgactaaaaatatgccctgggttttcttccccctcctgtcattattgaggactccatggtctaagagattaggctgaagtttttgttagccttttcaaattgaattgaattttagaacaagttaagacattttggctgatgcagtgattcattgtaacattggacaaaatttttagttcagccatctgtaaacaggagtactgtaccatggctctggaagctagtgtttttctgtgttcatagattattttgcaatggtattgaaaggtactaattgccatttgaggtcttaagttctttgtaaatctcataagcacagtggaagcagtagctacaaagaatagatgaatttatccatttgcagtaaaaactgatttgtatgtaatctgttgtactttgaacccagttgagcactggattctaaaacaagtctctttggtcgtggagagtttctattttaaacaagaaaagttatcaggaacttttgtgctgccttaaaaacatcactttttaaaattcaccagcaacaaaaaatagtatcacttacattccgtatttcataacattggactatttattcctaatgttggtcaaatcaagggtacagtagcaactgattatttaagcagtaatttagaaagattttttttcctttgaatcagtagagggtcaaaatttttaaaactttccaaagaaccttaaaacaggaaaaaatgaaaatgtgggggaaatgtaccagttttttttaatttaaattccctaaaataaaaatatttacaacatgagttacagaatttccatctgatttttattgtacaggaggagtatattctgtgatatcagtatacaattcaaaatacaaaaaattacctgggcgtagtgggaggtgcctgtaatccgagctgcttgggagactgaggcaggagaatcgcttgaacctgggaggcggaggttgcagtgagccaagatcgctccactgcactccaacctgggcgacagagtgagactgtcaaaaaaaaaaaaattacttagattgtgtatgaggtgcctgcatactagaaatgttcttttgagttacaaatctgtctctctgaccatagagagtaattatttaatcttgtgagtttgagttttatatcaaaccatttcctaaagcttacttgtaattacttttactttatgtttttgtagttatacatgtgtatatatatacacatacatacacacacacatatacatatatcagtgagaccttttaaattttagctgaattctggtttcataacttgtgattttttttccggtactgggggattgaatgtttttaactgttgtgcagatagactgaataaaggaagtgagcatccattaaaaactctagtaaataatttggattttttttttttttgagatggagtcccactctgtcgcccaggctggagtgcagtggcacggtctccgctcactgcaagctccgcctccagggttcacgccattcacctgcctcagcctcccgagtagctgagactacaggcgcccgccaccacacctggctaattttttgtgttttagtagagacggggtttcactgtgttagccaggatggtctggatctcctgacctcgagatccacctgcctcggcctcccaaagtgctgggattacaggcgtgagccactgtgcccggcctttgtttttttgttgttgttgttttgttttttgttttttttgagacagagtctcgctctgtcagtcaggctggagtgcagtggcacgatctcagttcaccacagcctccgcctccaggggtcaagcagtcctccagtctaagcctcccgagtagctgggaatactgtgcctggctaattttttttttttttttttttttttttgagacggagtctctctctgtcccccaggctggagtgcagtggtgcaatctcagctcactgcaacctccgcctccaggttcaagcagatctcctgccttagctagtactacaggcgcacaccaccgcacccagctaagttttgtatttttagtagagaggggatttcaccatattggtcaggctggtctcgaattcctgacctcaggtgatccacctggcttggcctcccaaagtgctgggattacaggcatgagccaccgcgcccggccaggttttgtattttttgtagagacgtttcgccatgttgcccaagctcacctcaaactcgtgggctcaagggatctgcccatcttggcctcccaagtgctgggattataggcatgagccactgtgcctggcccagcatttcactaagtaactttattttaaaaatatacagtgaactgattgccgaagtggtggattgcctctacctgtttcctttttctttgccttgtaggaagggaaaaagatgaaaggaaacatgttttgtctatttagtagcaatttttggtgaaagcttctggaaaggaaatggaaaatgctgggtaaaatgaaattataattatctgtgtattctaaaatttatcctcacattagaatatatttttcaaagttactttatactaaattcagggactttctaagttctcagttaatagaactgaaagggtatcaataaaataaggactatatatataatctatttttacttagtttttatgcgccaaaaggtatgtatgttgcatccagctgtttgttaccttgtgttttaaagttgcagttagaatgtggaatcctattactacattgtgccaacatatttgtggctgatgcttctaagttatccacaagcttctcaatacaatagcaaaatgcaggaattcctctggaatcttgaattgagggataggatgagatatataacatatgttatctgttgttttctcctactgctcttgaaattaacaaacttgagatagtgtactgatttgtatttataagattggctgagttcaaatatgtctttttgacgttcttaccaatgtttaaaatatagaaaagtataaagaagaaaatgagtatcatccgtaatgccatcactacaatgacttttttaaagcaaaatgtgtactttccttctgaagctttccaacctccttgcctcctcagtgagaatgatgacatactgttgttagagttgttgaggatcaaatgcagtattactcatgaatgtttcataaaccataaaataatacagtaatgtactatttttttttttgacagcctcactctgtcacccaggctggagtgcagtggcacaaacttggctcactgcagcttcaacctcccagattcaagccattctccagcctcagctccccaagtagctgggcctacaggcgcatgccaccatgcccagctaatttttgtattttttgtagagacggggtctcaccatgttgcccatgctggtctgaactcctgagctcaagtaatctgcccgcctccacctcccaaactgctaggattacaggcatgagccaccatacccagctgtattagttcttgttctataaagctttttttttttttttttttttttttgaggtggagtctgtcgcccaggctagaatgcagtggcacaatcttcgctcagtgcaacctctgctcccaggttcaagcaattcacctgcctcagcctctcgagtagctgggattacaggcatgcgccaccacgcctggctaattttttttgtatttttcttagagacggggcttcaccatattggccaggctggtctcgaactcctcaccttgtgatctgcccgcctcggcctcccaaagtgctgggattgcaggcgtgagccaccttgcctggccctataaagcttttattctcctatggcattgcttaagaatcccattaaagtatgaataaggactaataaataattgtgagttttgattagtgtaacaaatgaattacctagatcagtattttcaaggtatggtccaaggaatcctggaggtcccctagacatttttggcgagtctacaagtgcaaaactatttttataatactgagacattctttgccgttttctttgtagtgacatttgtacctgtagtataaaaacagtggtggataaaacttctggcgctttagaataaaccaggttagagtacttcactgtcctagtaatcattgtattattcactgccatgcactcagatttttttttaagtttcacctaaatgctcttgatgaagaagtaaaaaaattttaaactaaatctctacctttgtacacatctttaatatactgtaacaaaatgggaagtatgcttaaaacactggcgaggccatggacagcaagcctcccagcactttgggaggctaagtccagcttgggcaatgtagtgagagcctgtctctcctattaaaaaaaaaaaagttagtgtggtcatgcacatctacagctactctggaggctgaggtggaaggatctcttgagcccaggagttggaggctgcagttagctgtgatcgtgccactgcgcttcaacctgggtgacagagcaagaccctgtctcgaaaaacaaaacaaaaacacttggcagcatactgaaatataatggttgtttctagggaaagtatttgtgtgattgagtcacacgctgaatcaatcttcatataatgccatttttgcttaaaagaatgccagacttgggcattaggctgacattttcttgaaaacagtgaggctttgctttagggaaaatagtggtagtatttatggtcgatgataaagttcctagattttaagcaaaaattttagaaagcttgtatcagctgctgtaagtatataatgaaatctgtcattatttgattatctgcataactgagtcagtatttccaaatgatcaatgcatagtattataaaaatcatacatgggtaagaaatctttacaaagtgtcagctagaccaatggattttaatgttatagagaacataaaagtttatcaataaggtatcctgttccatattgcaaccaattgctgagctttggtgtagtgtcaaagaccagtatccagatttatctgaaaatgctattaaaatattcccaactgtctaatgtattttgtattacttatttttccatgctttgctctcagtgtttaatgtcttctttgatttattttgtttatatttttgttggaaacaggaatgggagccatagataaatgtgaagcaatgttttcatgtgctttatcttaaaatctcctattaatatataatcagtttaacttctttgtagtcttctctgtgcattccattcaacttttggtcttggtaatggattagataatagttatttttaagcctatttttggttttaatatttgttttgtatacctgactgctcatctatagacagaattcccttgtgtccaaagtctaacataatccttaagtagatttttagtagttgactttctcagttttaaaatatttgataacttttccatagtaaagctgtaagtttcaagtttagtaatgtctttttgacctgagaatttggtgtgttgtcttaccttaagtagacacttttcaaaaacacacctgtagaatgatcctttttttacctttcaggagaatgctgtttcttggtggtggtggtttttttatttttttatttttttttatttttatttttattttttttaagactgagtctctctattgtcacccaggatggactgtggaatgcaatggtgcaatctcagctcattgtaacctcctcctcccaggttcaagcgattctcttgcctcagcctcccaagtagctgggattgcaggcaccaccaccatgcctggctaatttttgtagttttagtagagacagggtttcaccatattggccaggctggtcccgaactcctgacctcaggtgatccgcccacctcggcctcccaaagtgctgggtagagccactctgtggccttcttttttatgttaatttaaaaacatttgtagcaatccttgttaaactgtttttataaactcatgggataagtccaaattttattttccttttcttttttttttttttgagacaaggtctcactgtcatctaggcttgagtgcagtgtcacaaccacgactcactgaagtctcgacctcccgggctcagttgatgcatctcagcgtcccaagtagctgggactacaggcgcatgccaccacacccaactaacttttgtagagacagggttttgccatgttgcccaggctggtgtcaaactccttggcctaatcggttcttccacctcagtcctccaaagtgctgggattacaggagtgagccaccgcaccggtctggttccacattttaaaggatttttagactgtgtttggatcgagtaatcagtttcagattaggagagtgttaagaaagatagttaagttacagtttgtattgtgcacagtttcttggaaatttagtgccagttatttccctagagagattaaaatggagagaaaagataattcagtctgaacaccagtgttgcaaagaacaaagttgacaccagaggaagaaaaaggtttagggaaggaatacatgtgaaaatgctaacttcagggtagcttcagggattaagcattatagaactcctgcctgcatgtgctaatcccatagagagcaagggaatttaacaggaagctttagtgctccctatattaaataattaactggtctgctgttctagcaattctgaattagggaacatactgagatcgtattttatgtccaggacatccaaattagtcacaaggttgtcactgactattatttatagagttttagttgctagttgaaaatattgcattaaatccttctattttagcttgtttatacttgtgtttttttcttccaggagctctcaacttaatcatccttcagcaaaaaagaattaagactaggtttgcaagcttttaaggacagaaaaagcatttataacatttctctgtttagatgaaagtgatgatggttaatgatggtgataataggcaatgaagaggtgaaagggcaggaagtagagcagaaaagagagtgaggatggtgattaagaggttcttgttaagtgcaggactactgttaaaagcaattcacttcacagttctggtcaacaggaatgataaactcaacattgaaaaacacttgtgatgctttagtggttgatacatcttacccatcagaaggtcctatgtagaggataaactggcattatatttgagttagagattatagtcttaaaatttcatcactaagcagtttgactggagagcctttgactagttctgcttcccagcagtcccttgtgtacttttctctggaccttcaggtactcaaattagacctttatttcattgtcctcatatgtttttttagctcattccattgggtgtgaaatcaaatctgagaactcaggtatttgttttaagtagttagaccttttattgtactctgttgtcttaaaaagcatggtttagtggtggtaacattgacctaggtgacaggcttcagtttagtttctggcactggtcatgaaactttgaacaagttaactcctctcttaggaccttatctttatgtagagaaagttggactaaatggctgttaaggtcttttcgggctttcaaatgctgtgtttctgtaataccacccttgtttaagccacagtcatctcttgtctggactcacaggagcttcctaacttgttttcatttttgtccttccccacattattttctacccagaatacaaagtgacctttttaaaaatgtaaatcagatcatgtaataccctccggtcccaatttacccttaagaaccagttccttatcaaggcctagaaggtactgcataatccagttcttgcttacttcacaactttatccccattactcactaagctctagccagctgtacttctttctgtgacaatcttttgccagccctctgcaattctgcctcagtctcaacagtggatctcagttcagatgtcacatttacagagttttttcctgatcaccttatataaaggagcattcctcttcattacctctgtagttcttaatcataatcaataattatatttatccatttgtttgcctctcatcccctctaaactgtttcaggacaggaagatcatgttacttttccaccactatctcaaatggttagcccaataactgcctagtgctcaagagaattattttagttagaaaaatacataaagtatgtaacggtttgtccatatcaattcccataataagctactccttaaactggtttttttcttcactcttttggtagtggcctggtctcataatcttgcccaggctagtctggaactactgggctcaaggatcttcctgcctcagactcccaaagtgctgggatttacaggcgtgagccaccacacccagccttaaactaatttttaaagttttatatctatgtccaactataattcctcattttttatttaggtcatctgtctcttgaggactatttgatctgattgcatgttattgaaagctaattgttcttagttactatatgttaggattaaattgagtaattttgcacaaaaggtttttagcaaagacatgaaaagttaaccagtataaaactgttagcagttcagaatatccaaatgagtgatataaatgagtgcttattagagtcaaaggaagaagtgaaacccttaggatctagtagttagaaaagacagtaaaaataaggtagaatctgcatattaaaggagttttagattaacagtgaattacagtgagcagtactacagaactacagaaattgaagtaaattcaagagtgttttgccctggtagatgtttgtaaaattgattatagggccataatcccttatctatatataacctttggtgccaggtatttttggatttcagaattttgaggaaagatttgttttagattttggtaagagtaatcaaacacaatattaatgtggaacatggatagtcacattaagtgagagaaataaaagataaaaatagtctcccatcagtgctcaggtgaagttttgccattatatattaggattaagctttgccaccaacatagttatagaactttgagttttcagagattttaggatttcagaatttctataagaagtcggtttcaggctgggtgtagtggctcacgcctgtaatcccagcactttggaaggccaaggtgggtggatcacgaggtcaggagatcgagaccatcctggctaacacggtgaaacccatctctactaaaaatacaaaaacttagccgggcatggtggcgcacgccagtagtcccagctactcaggaggctgaggcgggagaatcgcttgaacccaggaggcggaggttgcagtgagccgagattgcgccatggcattccagcctgggcgacagagtgagactctatctcagggaaaaaaaaaaaaaaagagagagagaagaaattggtttcaaatgagttaaaaaggctttattcattactgtttggagaagataccagggtctgaaaatgttactttgaagcaattagctttagaaaccctctttgccaaggaattgtttgaccctgactcaggatggaatgcagtgctgagggtgatgagtctttagggtatgggagaatcacctcattctataattgcagagtccagttaaatttggaaatagttaagattggtgcctaacaaacactaacatttttttaaatgtttaaatattgagagctcataactacagtttcatcttggtgatttttttagtcttataaggtattaggcagtttgtttcctaataatgtttttaagaattatttgatacatttaattgtaagaatacaatagattagaataggaatattataaataggactaatgtaatcctcatttaaaaatcctcagaccagacacggtggctcacgtctgtaatcccagcactttgggaggccaaggcaggcagagcactttgggaggccagggcgggcggatcacttgaggccagaagttcgagaccagtctggccaacatggtgaaaccccatctttactaaaaatatgaaaattagccaggcatggtggtgtgttcctgtagtcccagctactcgggaggctgagcaggagaatcgctggaacctggcaggcagaacttgcagtgagctgagatcgtgccactgcactccagcctaggcgacagagtgagactccgtctcaaacaacaacaacaacaaaagctcctcgatggaaccatttgatagtgacaaggattgaagtaagtatctgaagaggctacttagaaactcagaattggttacaggaagtgactgcccactttccatgtgttcttcagatgctctggttattctaacagcctagttaaccacccagactttggttctcattgcctttatccatttgtttggtgtatatactaatgttcaacgatgcacacataatgcatgtgatgttttttggataccgtcttatcacttgtagaattgccatgataggcattttttggagctactttaagtacttgctggcctagtaattatgcaagtaagtaattaagtgtttattcatatgtgaaagcccaatgtaagcattatttatgtctttcagtgaagtgtggtgtgcctttcatttttctgagtggtctttattttatggaatattaaatggatctttgaataaactcaagagggtagattataaaaggaagaactgttaaattagtcaaaaacaactttataacacaattagctgcataagccagtgcgtgcgtaagcaggtagtataaatgcttaggttgagatactaaaattattattagagaaaattacaggaagtacctatgctcccactatgttttgttacttggttaatttttctcctctgaacttctggcaggtttactggggaattttccattaggaatattctggtccttaagtttcattttgaatgtataatataatcatgcagattacgaacccacaatctaaaatcaaggcattcttttttaaagtttcagatgaggctgggtgtggggctcatgcctgtaatcccaacactttgggaggccgaggcgggtggatcatgaggtcgagagatcgataccatcctggccagcatggtgaaacctccccgtctctactaaaaatacaaaaattagccgagcgtggtggcgcgcacctgtagtcctagctactcgggaggctgaggcaagagaattgcttgaatccaggaggcagatgttgcagtgagccaagatcgtgccgctgcactccagtctggcgatagagcgagactctgtctcaaaaaaaaaaaaaaagtttcaggtgtattcaggagtggtcatattaagcttgtcacctgatcctggttatgaggttaacagcaaaatgaaataaaatatttttctgagccatttgtttctcctctcatggaagacactaattctgtttatttctatattcggccttgtgttgaaacagactgtaaaatcatgttttaaaaaagcttcacccatccttgtggagggtggtggtttgcaaaagcaccaccccacttaagcatttatattgagaagatatttatggcattcttccattcatgaaaatgggtatgctttgttctggagttcttaccttgatttatctactaacactaaagttcctcacttccaatttcttatacctctaacccaacagcttataaactgcatgtagtatagtatttgcttgaaatatgtgaaagtagttattttccctaactaatagggatatttctgtggtggttgtagttactttgcaacctgttcagcaaatattatagggcgtttttgatggtatctttaaattttggacatagagaaccatcttggataacctctttccccccagtctcagtcatccctttggaggtagtgtctcatttttaatctgtgacttgtggaagttaaggcatttgagtagcttatttaaagtattaataatctgatttctggagatctgaggaatagcagacacccttttctgtattaaattggggaaatttattttataggcaaaaagatgaataaaatggtcctagtagacagcccctaatatttctggtctcgggtaaaggtcttaaggaagagggaaggtagtatcagaattttccagggtgttttttttttgttgtttgtttgtttgtttgttttgggtggacaggaagtagaatttattggtgagtattaagagggggcagcacagtggaagccctcatgagtgcagggcccgccacttgtccacagggccacgattggaaatgtacttgacccgacagccatctgggatgagccgcttctcagtcaccatgtcttcaaactcattggcattgaacttggtgaagccccacttctttgagatgtggatcttctggcggccagaaaacttgaacttggccctgcgcagggcctcaatcacatgctccttgttctgcagcttggtgtgaatggagatgataacttggccagtgtgaaccctggccacagtgccctggggcttcccaaaggcacctcgcatgcctgtttggaacctacactggggtagtgcaaggtcagaaacatgaacatccatctgaaaggactgtctccagggtcccttagagcaacccatacaatacaacacacaggctgcatacactaccaaggaagctgctgtttgcagccattgcacactgggcccccccatgaggaaaggaactcagttggcttaataggctgcagcagggtgttttttaaaacacacaaatatacccaatccctactagaatgagagattttactaataatagtgttaggagtataaatggtttggtagccaaccactactttaaaattgattaggtctcccgggcttctgggccttcacatttaaatttgacctgaccttgaaacttcacctctcgttattcccagcgtgacttttgttttacccacttttcgaaataccccatgtgtagctccttacttcacgtcatgctggaatgtgacccataccagccaaactacatctaacagaaacataatacctaactaaaagcgtcttttatcatatagatagatgtacagggtatgttaatttatctttagagagactccccagtatactgaaaaaacagacctaagttttggtagatagccttgctttatagaaaatgaaaatgggccagacagtggtgactcattcctgaaatcccaacactttgggaggccaaggcaggaggatcacttttgaggccaggagtttgagaccagcctgggcaacatagcaagaccctgtatctgcaaaaaatttaaaaaaaaaaatttaatcaggcatgcagcacacgcctatagtccagttactcaggatgttgaggtgggtagatcgcttgagcccaggagttgaggctgtagtgagctatgattgcacctctgcactctagcctgggtaacagaatgagaccctgtctcttaaaaagaaggaaatgaagatgccagatactagcttttccagcctcccttgcagctagggcacaagtacttgacctaggccccacaaaattacatgtactttaacttgagatggaagagatgataaatttctgatagatttctcttctcctcttggttgatgtacaccacaaatcagttttctgctgcagaaacaactgatacaaactgaagcatctactgttagtgatgtgacagcagtttcctcacctggccagttttgtaatacggtttcgggtgtttgtggctatgttagcttccaacttcattctctagttttccacagtaattttgtaagttgcttggtattttttaatgacttatttttatatgtaaatgtgatttgtataacttccaacaggaaaccttgtccaatgcgtgattttagaaaatttagcaaaaacttttcaaagggatatttatgtgaagaaaatgagtggtatccttgtgagagaaaagtacaagaatgagactggggcaaactgcttttccagaaataaagaggccctgatggtgtcacttttggtagatccaagcttttcatgaatattgaagctctggatgccttgttcagtagtttcataagcaaaaatccaaaagtgtagaaagagttttaattgaaattaaataaaatcaaaattttagttttacagttacactaaccacattttaagtccttgatagtcatctgtggctagtggctactatactggacagtccagatagaacactatcattacaggaagctctattggacagcactagtctggattctaatcctaaatctacagtcttgtggttctgcaacctcaggtaagtaatctgaatcacaaatcctttatctctttttatttatttatttatcttctatctgtctgtctgtctgtctctgtctattttgagacaagtctcactctgttgcccaggctggagtgcagtggtgcagtcacaactcacctcagcctcctgagtagctagggccacaggcatgcaccaccatgcccaggtaattttttgtagagacaaggtttcacaatgtttcccagtctggtatcgaactcctgagctcaagccatctacctaccccagcctctcaaagtgctaggattacaggcgtgagcccttgtgcccagccaaatcctttatctaaagacagtaccttattttcattgttgctctgaagattgaaatttaatatatggaaggacatggtaagagctttaaaagcaccatacagacatgtcagtgttcagattagaaatatatttattggttaacaaaggatttttctaaaataatctgaagagaaacttcagaacctcagtggcatgaatactttgatgttagaccgtgtgtattttaaccacttgaagaatctaaatgcacaaaattaacagattagattttcattttaaatgtgaaatatattttacccaagctgtccttttcaattttatctataaatcttaaagtttttatatgtactgggggcttaccttcttgctgtaggttccctttatatatactgttttatcatcctcatgaatgatcttaaacaactcaatctgttaactaagtgaataatgtacctgtcacatagaggtattgaatgaatgttataaatatgatagctatctatgccagaaatcgttggttttggtagacagacttcagcattcagcacgatcattctcagtaattctttataggtgttttgatttgttttgagggggttgtttggcatatattttgcaactaattaattcatttttgtaaaaccatcagacaacagtgctagatgtttaaaatattctacagcagaaattttcaaatgtttttggaatcattaatacaaccctgtctctccttcacttaaaccacagtagccattggtaattgagaactagattctttccctttgagtcctagttgatctcaaaaatcattctcaacactgcacttagctacaggtagctgttaatattttgagttgatgactaagctgaaacccatttgccacctgtgagttaatgggcaaggtctatccttgtctcttccaggctctagcctatagtgcaagtgttggcaaactttttctgtaaaggacctgataactattttaagccttgttaaccatacagtctcttatcacaaccattcacctctgctattgtagcctgaagccagctgtggacaagacacaacaaatgaactatgttccattaaaactttatgagtgtgactgtgttccaacaaaattttatttaccaaaaaaaacaaaaacaaaaaaacagggagcaaatgggatttggcctgggagttctagttggccaacctcccctctagggcaagaaactggttttgattcattcaacaaataattaggtgtcttccatattccaggcactgtgttaagttttgattatatagcaataatcattacacgtaggccccaggtcatgaggtatttaacccttaactgagtatggttttggggctttttgcttttttggttttggggtcttttttgtttttgtttttttgtttttttcaaggcaggttctcactctgtcacccaggctagagtgaagtggcgctgtcacagctcactgcaacctcaacctccccaggctcaggtgatcctttcacctcccatcctcccgggtaggtggaactacaggcgcaggccaccacgcctggctaattttgtgtatttttttgtaggggtggggtttcgccttgttgcccaaggattacaggtgtcaaccaccgcatccagcctgaatttgttttttttttcatgtactttggcagattcgaagtacttttttgagggaaaaatggagtctgccccatacatctgctttatttgttaatacatgtgaggttgtaggcaaataccctaagtgctatgttctgtgatagtggtataactaaatgtaacttcaatgtgccttagatattagatgccatggtatcaaaattaatatcctgttataaaaaatagggaagcaaaaatgtttgcatatgatacctaccctggctgcacatagcagatacttaatatccatataatattgaataaagctgaaattaccagtttcttaactatccttatgtcactttcttgcagtttcttccatttggtatgctatttctgacctcattttttgtttttcgccaaaaaattaccacatattactcatattttaatgaaatgcttaccatgcctagatgtattgttcagccttctactgttagaacttctttcgttaatttaaaagtatctttagttttctcagtattcatgtttatcttcaaaatgtctattgttgttgcttattaaatgagtcagagctcttcactgatactcagagatctccttaatcttaactgaagattactgctatttttattttcctattcctttgtgccctgtgagccagtcagactgctttttccgctatagtctaattaatgttcccatgttatgctgccttttgtgcctttgctctcacttttcttatccctggtatgttctttcctgttgaaatattgtaacttttttttttgccaccctcttcataaatctgatctctccttctgaactcccatagtattttgtacatctcatgatatttttcatatttttatgtctccatcttttcctacaaaattgtaagctttttgagagcaggtatgttttgtccatctttcagaatatgaaataagaagcaaattcctgtcagaacatattccacctaaaatggccaaccattcttgttttcccaggatggagagtttcctcagacatgagactttccgtgcttaaacctggaccgttggtcactctgattccacttcatgatgtagccatcttttttgcatatcagtgctttactgcaggttttttttttctttttctttttaaagaataaacacataaaatgaacatgaaggaaacagttttttgggttttggatttgttttttttttttttttgtttgttttttttttccagactgtttggctgtcacccaggctggaatgcagccacggtctcagctcactgcaacctccgcctcccaggttcaattcttgggcctcagtctcctgagtagctgggactacaggtgtgtgtgaacatacccggctaacttttgtatttttattagagacagggttttgccatgttggccaggctggtctcaaactcctggcctcaagtgatcctcctgcctcagcctcccaatgtgttaggattacaggcatgagccactatgcccagccaaacaaaaattttttttaattaacaaagcaaaattacttgtgccttttaagcaaatgtttggaagattatactcatatgtagaaatgtaaagatcagattcagatgataaaaaaggccaaaatgtgggaaaattttgactaaagttgaaaaagaatgatgtccttttcacaagcagagggactcttcagtaggtttggtttatggttagtagacacagtttttttttagagtagaccctgtaaaagaatgtggagtaaatggtggcagtggtttgaccacaacagtggtgtctattgctagagaaattaaaaataagatataagatacttaactctcctttttacaaaaggcttcagataaagaggaaatgggagcaaatccagagattataggcactgtatgggctaatgatttttttagagatgatgcctcactatgttgtctaggctggtctggaactcctggccccaagcagtcctcccactcaagcaagactgaagtaactgggactatagatgtgagctatcatgcccagttggcaggcgatttttatatgttatggtttattgtacaatacaagctattcactgcgtgttttattgtgagaagctcactaagttagaaaggttttcagttttgtgcagtatttttttctgttcctatttctatttctcataagctgggaaaaacatcatcagagttcattgggtgacatcttacatctaaaaccttaaaactaagttgagatttattatcacaaaataaattcccccatacctccactgaaccccccaccacccatgacttgatgacttcaatcatactcatcccgttccccagagcgccctcactttccaagtgaactcccctattccctaatgatttatatatccactggtctggtttaagtatccacttaggaagccttgcctggtagttctttatagatagacaattgttctcttctctgcatccacagcaagcactttattctgtagaccctgcttcattgtgagctaacacagcgcaaacactgtgaacattttaatttataaaacagagtgtcttctgggctttaatatgtagttgtcacatttgcttttcctcagatttctgggccacataacctctgtcacagttaaaactaatatctcggctgggtgcggtggctcaagcctgtaatcccagcactttgggaggccgaggcaggcggctcttgaggtcaagagtttgagaccagcctggccaatgtggtgaaaccccgtctctactaaaaaatacaaaaattagccaggcatggtggcgtgtgctcgtagtcccagctactcaggaggttgaggcaggagaatcacttgaacttgggaggtggaggttgcagtgagctgagatcgtgccactgcactccagcctgggcaatacagtaagactctgtctcaaaaaaacaaaaaaacttaacatctctaatctggtcattgaaattgaggtgtaaagcaaattaatgttttctcgttgcctcttgtatcctcctcttcccgtgtaagaaataataaggcccagtataaggtagtggagtagagagaatggaattgattccagaaataccaaggtagaatgaatcagacttgataatggagtgaagagagaagaatccatgacaactcccaggtatacagctacctattaaaataatatgctattgaagtcctttaggtgtcttaagcactataaacacctagatagatataattttaaaaaatagcaaattaacatttactggctacttcctatgtgttactcattgtgctacacattttgcatagggtaagttatttcatttgaatctttaagaactgtaagaagtagatacttttatttccattttcaaatgaggaaatgagacacagtttaaaataacgagaccaaagccactcaagtagaactgattccaacccagacaatgggatctaaagcctatactgagtcagtatgcatccctgtagattttactgctagttcagatgacagggaaaaaaggacatttttttaagtcacatctagagaattgggagcagggaggagttctacacaaatacagcctatttggaaagatctgatagaaactaataaggtgatcttgagcctatattattatttttttttttacctgtttttgaattgttggtctctccttttttaaaaaatcacttaactattttgcttatctcttgactcggctgagaaatctattaaactggttcttctgcatttgtcagattgttgataaattgttaccctctattctgtattctaccatacatgatcaaatactgaactgaaaaggtaactatagaaataaagctggaaaagctaaccttacgttgcatgtcaaattatatgttgttgaatatttcagggagaaagttggtgtgattaattgaaaaaacttgatttactagcagtattaatccatgaaaagggcaagggaatttttttctttcttgaggtattataaatatgatcagaatagagaaaatgctatacacagtttgataatctacaaattttgcactttctagatttagaaatcttgttcacaggagatctttcttggcagaatgagtaagattggaaacattttccatgtgtcctcattatgagagaggcagacaactcaaagtaaatatgataagcagtcttcattttagcagctttctatttattttatagttccttgttagaagttttatttttaaaagagggtaggagaggcagtgtttgggccccttattttttccttcaaaaagaatttttaaagtctgtcattgtgttaaacagattcataacaggtccttctgacagttgaattagttgattttatttgggaatgagaaaaggacacagttaccctctttagctgttaaagtattacttttggagttggagatggaaaggagaaatcaagtatcttctcttccagaaagtgcagtgggagaagtaatgttacctgacttcaggaaccagtatttaaggcctctttttttgagacagagtcactctgtcacccaggctggagtgcagtggtgcgatctcggctcactgcaacctccgcctcctgggtacaagcaattctcctgccttagcctccctaatagctgggattacaggcgcccgccacctcacccagccaatttttgtattttggtagagacggggtttcaccatattggccaggctggtctcgaactcctgacctcaagcaatccacccgcctcggcctcccaaagtgctgggattacaggcatgagccagcgtgcctggcctacttaggcctgtttttataatttagggtcacagaatttcaaactggggttagggggtgagtgtagtagttaaacaacttgagattggagaactgcttttgcaaaatttccattttggttatacccatgaaattttttttttgttacgaagtcttgctctgtagcccaggcttgagtgcagtggcaaaatctctacttactgcaaattccgcctcctggattcaagcgattctcctgcctcagcttcctgagtatctgggactacaagcgcccgccaccacattcgagtattttttttttttgtatttttagtagagatggggcttcaccatattggccaggctggtcgcaaactcctgacctcaagtgatctgcccgccttggcctcccaaagtcctggtattacaggcatgagccatgacagtcagctattttttttggcatattttaagggacagaaattatgctttttaaatgttgcttattgcttttcaaggatttgattcttataagctacttcttcatttattaatgagatttaagaaagaaatcaggttacaaagttatgagcaattgtctctggaacccagaagttggttttaacactagagtttctgctgcagggcatttttactggactgtgattcctagaaggcaagtataagcactgtttttttgttgtttgtttgttttagaaacaagttcttgcgtcacccatgatagagtgcagtaatgcagtcatagctcactgtaacctccaattcgtgggcttaagtgatcctcctacctcattcttttgagcagctgggactctaggcatgtaccaccacacccagctactttataaattttttgtagaagtgtggttttgctgtgttgtccagaatagtcttgagcagtcttcccacctcagcctcccaaaatgctgggattgtacaggtaggtgtgagccaccatgcctatccctgctgtttttttttgagacggagtctctgttcaagcaattctcctgcctcagcctccggagtagctgggattacaggtgtgcaccatcatgcccagctaatttttgtatttttagtagcgatggggtttcaccatgttggccaggctcatctcgaactcctgacctcaggtgatccacccacctcagcctcccaatgtgctgagattccaggcatgagccaccacacccggcctgtccctactttttttaatgccaagatttgtgtatttcatcttcagttgggattcatggcatctgtcaataattgatgtgaacttaaatggcaatttacctataaaaagataacttactactcttcttttaaaagtctatatacttctgtcatttgctggaaatgaattattagtctttattcagcaaacatttatagaccaaatagtgggtaccaaaataagtactaccctgcagctgcttgatgatggtaataactaacatgtaaatctttaataaacagtgtacattcttaatctgtccatcaactcggtacagtcagtattgttgtccgtatttcacagattaagacaccagcctagaggccgagtgcagtggctcacgcctgtaatcccagcactttgggaggcccaggcgggtggatcaccttaggtcaggagtttaggataagcctggccatcatggtgaaaccccacctctactaaaaatataaaattagccaggtgtggtggcacgcacctgtaatcccagctgctcgggaggctgagagaggagaatcagttgaaccagggaggctgaggttgcagtgagctgagatcacacaccactgcactccagcctgggtgacaagagtaaaactccatctcaaaaaaaaaaaaaaaaaaaaaaaaaaaaacaagatgccagcctagaaataaatgaccacccccctggtaaattacgtagctagttttggtctccttatttccagatttcatgttttatcaccctgagctccaaagatgatacagtatttacttttaagtgtataaggaaaaactgagtttgggcctcaaaccagccccaggatttctttatttaccaattatgaactagcctcactcagttcaggaagtctcttaaaatgtcagttatttggtttcatcttcttaaaatgtagaattgctttatgttatttaaatatgggtccttttttttaatgagttaatttgtttgcttttcaagataattttggattcaaagtttttaaggtaacctgggatgcaaattttgctaactggattaatacaaatttaagtttttaaaattccattgttcaactgtgttttatcctggataggattaaagcagtctttaaaggtaatctgttgttggctttaatgttttatagtacagtctggtgacacttggctcactagtccacattttttgtatatttggtatatagattttttccttggtagtcacttgtttttaacttctttttatattttacttcccagtcttaatctctgtaaccaatttgtataatcccttatacagttagtctctttatttgtggtattatttgaagagaagtgtgtttcctgagagaggatgtcatgtccgtgccctaatttttagttacatggcttttatttgcataaatagcatgcgagaaggtaaaggaaaatgtggttgcatcttgtcctggttgagtgcccactagtcttaatggattttcccagttgtgcatactttaggagtaaggatgttgtcttacgtttattttcactcctttttaaaatgtgtattgtttttgaaagataatgactccaaaatatctataatatcaaacaaccattatgaagttagagaaataatatttagattatattaaattttattaccagtgcaatttatttttttatagtaattaaggaatctaacttttttttgttttttgagacagagtctcactctgtatgcctaagctggagtgcagtggcgcaatcttggctcactgcagcctcggccttccaggttcaaatgattctcctgcctcagcctcctgagcacctgggattacaggcatgcaccaccaaacccgactgatttttgtattttttagtatagacggggtttcaccatgttggccagctagtgtcgaattcctcacttcaagtgatctgcctgcctcggccccgcaaagtgctgggattacagacatgagtcaccacgcccaacctaagatgcttttaaaattccatttatgtttaattcttcaaagtctggtacatgtaacattattataacaaaacattttataattgaaagggactttagggatctagtcgagaagtcaaaaactgctggaccagggttcagagctcttatctctcaaattgattttgttggtttatacaatattcataatttttagaattcaaatgactttacccgtaaagcattcactccctacttgaccacagtctatgttattacctaataagaccttaactgcttcaagcgtttacatggttacctggctgatgtaagtcatctgagtgttcagtatttcccctttccctcattccatctttttgtagacaaggaatctggaaaccaagaattaagtgatttatctcaaaatatacgactttttaaatagagcttcttaaattcaaagttaatgttactttctacagcttgttgtctccttagaaaatagtacaaggtaatacgtaatcaagtcctaaagtatttggtataacttgtcatgaaggagaatgatcactgtgggctgagttagtgcaagaatgcttcagagacatttccttgacactaacctcctaagaactgcatcttgagatatgctgccctgatctgtgttgtttttgctacacagctgaggaaaagaggtacatatcctcctctaaagagctggcacaggaactcaccaaagggcattttgtacatattgaaaaacagcacctcataagaccaactacatttagacttctccagaaatcccatttatgcccctttttgcagaggaaggggctggattgactcccaaatccaaatttaacttcagccacaaactaattagcatgtcaccccaccaaagatttttttttttttttgggagactgagtcctgctctgtgctaggctggagtgcagtggcacaatctcagctcactgtagcctctgcctcctgggttcaagcgattctcctgcctcagcctcctgagtagctgggattacaggcatgcaccaccacaaccggctaatttttgtatttttagtagagatggggtttcaccatgttggtcaggatggtctccatctcctgacctcgtgatccacccacctcagcctcccagagtgctgggattacaggcatgagccaccatgcccggcccaaagatgattttttaaatgctcaacaggacaaagcctaatggtagtcttttgttaaaaacaaaatttaatatcaatccattgacaggactctttgtgtactgagctatatagtaatttcaccttaatagaagttcttcataaccaccccatataaaaccatccattcttatctcttttttttttctccatactgcttatcacagctgacactttatactgactttgtttccccctctataccctttactccagattataaattctgaggacagggtctttctttcactgctttatattcccactgcctagaatagtgcctaacatatattaggtactcattatatatttattgatgtcaaatattgattgctgtattatagtagtgttaatggaaggtgtcatttcttagattttcttttctgaccagcacagttcttgggttgatggagtatgtcctcaataaatctcagcatcaaataaacaagaattttctttttaatacataaatttgtcattttgttacgctttttagtttcctcagtgattttttagaataattcttgttcataatttggatcagtaatatctacagttgaatcttaggaagaatgttataggcaatccagaatgttggataattaaatcagttatttgcattttgatgtgtaatatagtgaacacatttagacaaaaaaaaagctaccccataagaccagtttttattttctttgattcatgtcttcaggattttctgttaactcagaattattatagcattcattattgttttgtgaaaatactagttaataatctccggttaatgaaataattatcttagataaatttactgaacttaatgtagaatatgttttttgtttcgttttgtttttgagacagggtctcacttgtcacccaggctggagtgcagtggcacaaacatgggtcactgcagcctcgactcctgggctcgagtgatgctcccacctcagcctctcaagtagctgggactacaggtgtgtgccactacacttggctaattttcatattttttgtagagacggggtttcaccatgttgcccgggctggtcttgaactcctcctgagttaaagcagtctgcttgtctctgtctgccagagtgctggcattataggcatgagccaccacccccttcttccactttcatttcaaacagttatgaagcagccactgaaaccggactctcgacaatgccaaaggaggttttgttttcttgtctttccatgtctttgctgtggtttgctctgaaactagaattaaacagctttttaaattgataaaaaagaaccaatgcaaataaaactacggtctgtagagtaaatggaaaaagttgtagaagtaataataaactacttttaaacaaatgagtaaggtagtagatattttgcaagaagtaaatagccaagtgtaaaagctgtcagttactttcatcaatcaggttagttgcagtcacgcaaattttaggtgattatataaggaactcaaattaggaatctttaaatgtaaatgacctaatactaaaaactacccaaaaaatatattcaaagataaatagaagaaatacttatgcatttgaaaaaatcgatgcattccacagttcctctgaatcaaaggtaaaaaaaaaaaacagtgtagaaaatactttgaacagtagtggaatttttagtattttgatagctttctttagaaatttaattgattttcttcatctgtaatcttagattgtgttggagaggcagtgtgaatcatgcataaagtttataattgtgtatgtgcctacatgatgtagaaattgcaccttttggctgatgaagtatcgtatagttgcactgttgataacattaagttcatttcgcatatatgctacagtcttttctgtttaacgcgttgagtaaaatgaagatccaggagtccctcattagttggtataattggttaattcatagactaaagatgaatacaaatgtactacatttgcagattaactcatacataggcatattattgttaactagcaattcttaactgtacagatagtttcaaactgcatccagtttttacaaataaatgctcttgtttataaggaataccataaagagagcacatgtaaatgaagaaaatcttgtcacttatactggaaattcaagcgagaatgatattaaaaaaaaagttgttaaaggcaacacaagaagttaaatgaaactgagttagcaatgagagatattggctaatttactgtgcctaaaattatggtgctattggtctactgtataattattatttttaatgtccagaatgtgtaatacaagggccagaacttcctcctggactcaattttataaattctcgattagttggtgaggccaataaggatactttttctcgtctaatttggtttctgggaaagcttcgttcaagtcctcagtggtcatctgatcaaatggaattaagttcttcatcttctccatctgtttctcatattctacaatcctggcctttgagagagacacccactcagcacaagatttcacatctttttcttcggcatccacctgcgcagtatatttatcctctggcacgggaaccttcagggcattaaacttcttaaagtcatccaccaaaccggccttggccacgttggccttgtagtaagcccagtcgataaccggtggattctcaggtaaagcagccaacctggaggtgagggtctcattccaggatttcaggaaactagcaatggccttttggttctggggtatgatctctgcaaaagctactcagtcagtggtttttagagcaagttttcgcccagccatgttgggattcttcaccgaccctggctgcccacggtccactgcagccgcctttaacttcttgaaggttgttcatcttaaaatttctttcagagtttttctgttgattatagtttttgtttttcttccaaaatctcttcactttaaatggtagtacatggcagtaataccttctaatagtcagaactcttaataatttataatatcaggtattctagtattacttcctatcctctttttgacttaatccttattttctactgatgtacaagtagttaaaaatgagcaagcttctcagaatgtaatcatttacttgtggcacaccagttaaagtactaacttaagtcctttgctaccatatttatcttttcattctagataaattttttgcttgctaattgtaaatattgcattgatataagataggtatttaaaatgtcagtatttacattgagtatttctttttctataaagcacttaaaatatatttaatgttgtaattttcagtagttaagcatctcttagtcctttttgagaagtgttttctgagaagtaattaagacttaaagaatagaattaaactttaattgattcttttatgcttacctgtttgtttctttaaaaaggtaccctcaccattagtttattaatccagtacttttccaacatcaatattttatagttactctatgagttgagtggctaaacttggtatttttgagttttctaaagtctacttcttaaaaatgccagtaattatcagcattcttataataatattggggtagttatagaacaacttcacaattcctctgttaacttcagtttttgtttcatttgttttataattttttctatttattaacaatagaactgtcaggaaaaaaaataagcaaaaggaaaagaaaattccctatccccccaccttgtcatgtattttttttcttttttttattccagggaattgaaattcattttctattataatctcaagattttttccgtactcttgaggtaatgtaataatgagattcctcctaggctgtcaaaattacagtctgcataacttgaggtacaatagatttcattaagacttctgtgattaatattagcggtcagagacaatgccaatattacaggatttttgtttagtaatgtgttttttaaatacttaaaagagggctatttcccagtcattatctctgaacatttttaaatgattcaaaatactgatgtatgcacaggtttttgcttttttatattgacatggagggttcttacatgtttttgagctagtagattaaagagtggaacagtgggccgggcacggtggctcacgcctgtaatcccagcactttgggaggccaaggcgggcggatcaggagattgagaccaatctggctaacgcggtgaaaccccgtctctactaaaaaaatacaaaaaattagctgggcgtgatggtgggcacctgtagtcccagctactcaggaggctgaggcaggagaatggcatgaacctgggaggcggaggttgcagtgagtcgagatggcgccactgcactccagcctgggtgacagagcaagactccatctcaaaaaaaaaagtcgagcagtgattctcaactgaaggaatagcagtcctctttagtgtactgagtggcagctcaaaccattgttactcttattttaaaagttacttttttttttttttttttttgagatggagtcttgctgtgtcgcccaggctggagtgcagtggtgcgatctgggctcactgcaacctccacctcctgggttcaagcagttctcctgcctcagccttccgagtaagtaggattacaggcatgtgccaccacacccggctaattttgtatttttagtagaggctttgccatgttggccaggctggtcttgaacttctgaccagcctggtccagctggtccagtgatccaaccgcctcggcctcccaaagtgctgggattacaggcgtgagccaccacgcctggcctgaaatttatcttttgttgacgagtatgtgcaaggtgttgtgtcagtgactctgaagaattactacatttctttccttattctttctttaatttattgatcacatatttcaggcacagtttcaggttctgggaatatggcagtgagtaaaacaaaaaaaatccctatcctcatggagtttacattctttgtaatccatctcacaaccttatcatgtagctgttactatcttaattttacctggaaggaaagtgaggctctgaaaggtttcgtgacttgcccaagattatagaaaaccacaatttgaaacttaggtaccattagccactatgctgtgctgtcaaaattgtccccccatggggttctgtgaaagagaacaattagtctcaatgtctcaaatagtagttgtcacaaatgtctttgaaaatctgatgtaactattcccatttttaattgtgcatgaaattttagggaattgacatatttcaaagtgctcattcttaacctgagctaaggacttcaggaaaagaacacttgaacagaaaggttatgcctaaagatcacaaatacgctatacaaataacaggtgctacagctctttcccagtccctaccagcaccacaagccaattatgttgcttattgaacagagttgtcttttctgcaaaactagatgcaaccacaccatcctaaaaacaggataatggctgttgccagtcagtcagagttggcattcgcaataaaaatctgtttttcagtcttttcaaggctggtgtagtagaaagcacagatttgaaaaatactgattcaaatcttgactattgtactgttgggttttttttgttttgttttgctgtttaaggtaacagaaataccctgataatatccccaaactggaaatcagctggtgtgaatgggtaaagaaaatatcatgtattcatgtggtatattttaatcaacagtaataaataaaaggagcaagttactgatagatacaataatatggatgaacctgactcattctagcaacaaataataatgctcattcatggataaatgaagcagctgggaaaaagagtcccagtcacctcactaagaagtgtagctcccacagccaactcagccacctttgtgaaataagaaaggcatacgtctcttagaaaaatcacctctgataaatgtatagtttttatattcagtattttaaaattgtagtttttatgttgtttcggtcagttgtgttatgtttggaggttttagtgaatatatagttatgcagccatcactacaaccagtttttggtgtgtttttttttttgagatggagtgttgcagtctcaccggggctggagtgcagtggcacgatctcagcttactgcaacctccacttctcgggttcactcgattctcctgccttagcctcccgagtagctgggattacatgtgcccaccaccatgcccagctaatttttgtacttttagtagaaacggggtttcaccatattggccaggctgaactcctgaccttgtgatccgcctgcctcagcctcccaaagtgctaggattacaggtgtgggccactgcgcccggcccactacaactagtttttagaacacttccatcacccccaaaaggtttcctgtgactatatgtagtcagtcccactctcactcccagtggaggaagggtggagaattggatgctcatatttcctttggagcagcaataatgaacagatttggggttattgtacttccatttgttagtgaacatgcaacatcagttcctcctgtggctctgtttgtacaagtagcctcatctgtgggcttgcatttcttcgaaaacaaagacctttttatttagttttttctagtttgtttgtaagactctgaaaatctcaaccattgtagattttttcggattaccaattttccattttaggtttcctatttcagacctgaacccatatacaaaaagaaaggccatctctttactttaactgttgggtctttgccagaatacttttgaaaatttccttaaatcaatttttattttgtatcctattgaatctttttgagacagaatctcactgtgttgcccaggctggactccagtggtgtgatctcagctcactgcaacctccacctcccaggttcaagcgattctcatgcctcggctttgcgagtagctgtgattacaggcgtgtaccaccacacccagctaatttttgtctttttttgtagaaacagggttttgaagccgggtgtggtggctcacgcctgtaatcccagcactttgggaggccgaggcaggtggatcatgaggtcaagagatcgagaccatcctggccaacatggtgaagccctgtccctgccccccactccactccccgcccccccccccccccccaaaaaagggttttgccatgttggccaggctggtcttgagctcctgatttcaagtgatccacccacctcagcctcccaaagtgctgggattacagacatgagccaccacatctggccgagttcttgattacctaagctatcctggtcagatacactgctctttttttcccttttttttttttttaatttccccaaccttgctagactgctggtcttacaggattttggggaattaggaagttccatggttggcaaactttcaaagacaggagcaggttaatgttagctatagaagcactgtcactcaagtgaagacagttgttgattggttggctttgggatgtgtctgtttaacaggccatttttgattgcctgagtttcagaagtaaggaaccctcattagttggttagtttgtagaagcatatcctctgaggcaaattgttattagttgattaaaatcatttaaatcagttatagtagctttgttaaccatgacccaaaaaactgtcatttcttgatcagaagttttaaaatctgttctggttgctacctttgtaccactttactgactctttagtttttttctaggaatgtaggagccttttattctcatgtaatgcccccaccctggaatccttgaagaccttctgtctattgttcatatactgaaattttataatgataagccttggtatggattgtttctttctggatatattttgtttttatttctactatttcatcatactaaacattctaagtagacgttttcagtctgggaactcatattcttcagttctgcctctgattcaagaccattttcaggttgtctgtacgttccccactttaggaataaatatttggtcttctgcttcctctaccaacatattatatttaccatttatgtatgccagggcttggccagatacgtaaatatttaggctctgttgtaactactttgctgttacagcacagaagaaaccacagacaatacacaaatgagtggatatggctgtgtttgagtaaaacttgatgtaacaaaacaggtgataggttggatttcttttcagacctgtgctctatcctggatcgggctcaaagtcatgtctgtaattctgtagttttcttctacctctgagcatcttttaataagtctgcttatagggtgctccatactagggttgtatagtaatcattttaaataaatctattttcctgaatgttttatttctgtgaaaagcacaggaatacacaactttacttagaattctttttttttttttcctttaataaggtactaggttttgacaagcttgcatcatgcgtgagtataagctagtcgttcttggctcaggaggcgttggaaagtctgctttggtaagtcattcttactttacctaagcctttcactccaagacgttctttttctgttgagttttaggttttgatgatttgtctttgttaagataaaattccttaatgactttagaagcaatataatatttttcttgtaattttattcaacttttaattatatctgggtggatcatattctctctggaacattgactccagaatgacacgagttatgctggaatacaatttgagctaagcacagagattgagagcgtacaaatacatgtctttttgcattcgcatttcagagccagataggaataaattttggtctttttatttatttatttttttgaaacagggtctcactctgttgcccaggctagggctcaagtgatctcagcctcctgaatgcttgggactacaggcacgtgccaccatgccaggctaatttttaaaattttttgtagagatggcgtcttgctatattgcttaggctggtcttaaactcctggcctcaagtaatccacctttgcctcccaaagtgctggaattacaggcataaatcaccatgcctggcttgctctttcttcttatgaatagtcttaccctgtacattttatgttagaaaatatcaaagcttataaaaagtcttcaaatattacctttgactgtccagctttacattttttaacggcacgttttctgcatcaaggaatggtatagcaagaatgaagacataactgggtaatgagggttgggaaagaggaaaaacgtagggaaaataatttgatgaatagttcagagcttagcaaagcctcacaagcaaatagattgaccttctgtctcactcataagataaaccatcttggccacttagaaaggccacctagctgagaagtgtcatgcttggaacaaactgagaagtacatacaatgtgaaatgaactgctttttcatttgtatccaaagtgatggggaggtcagttgatcctgcatgtatgtgtgtatacataacaattagtcaatttctaatttaaaaatcaaatttaagctcttaagactgaaacaatgccggcacagtggctcacgcctgtaatcccagcactttgggaggctgaggtgggcggatcacctgaggtcaggagttcgagagcagcctggccaatatagtgaaaccccgtctctactaaaaatataaaaattagccaggtgtggtggtgcatgcctgtaatcccagctactcgggaggctgatgtgggagaatggcctgaacccgggaggcagaggttgcagtgagccaaaattgcgtcactgcacttcagcctgggagacagagcaagactctgtctcaaagaaaaaaaacaaaggactgaaaccagagacatttaaaattttttaatatatgatctctaaatttagaattacccaataaggagcatagtgattatttatttaaaaataaacagcttcctgaggtaattttcttaccaaatgtacacattcgaatgtagtattggctgtggttttttttttcattgatggtgtaactccctgtgtgaactcagtttacaattacattaaagattgaatgtactcttttctttagaagtataatggtttcttaatttttttttcagactgtacaatttgttcaaggaatttttgtagaaaaatacgatcctacgatagaagattcttatagaaaggtatatattactttggaaggccttttgcttttgattttaatataaatacttattttagctttataattattgaatgttttatacaaaggatggaggcagagttaatttataaaattagtgggaaaagtttacactttctggcattgcatagttaccagtttaagaggatcataaacacccatactctcacatattcacagaattttttgtaatttgacacataaactttaaagcagaccatccatttcaagtagtagccccatgttactttcagtcccctacctagcaagactgattactctcaagctcccttctttttaacctagaaataggtggacacaggtcttcctaagctttctacttactaacctcttgagaaagtgccaccactcacaatactggttgaatatcccttatctgaaataactgggaccagaagtatttcagatttcagattattttctgattttagaatatttgtatatacataatgaaatagaatgggacccacatctaaacaattcatggtttcatatacacctcatacacataatcttacataatatttttaatattcttatgcatgatacaaagttttggctgcattttgactgtgactggtcacatgagctcatgtgtggaattttccacttgtagcgtgatgttccacacatggctcaaaaacttttggatttggaacattgcaagttttggatttttagattagggatgctcagcctatagaaaggtgaattcctgtgtccactaacagcatgtgacaataaaacaatgtgtagacatttttaacttagtagggaaagaggtatttcccaacctctatgaagcagccaacctggccccgctgttgcacaaatactgtgtttccattcctccctccatgtgcatagtctaccaaaaaaaaaactggaaacttttgcaccccagctgtgagacagtattactcttttctttctacatctaattctaaatacctatttttccctaggaaatattagatggaaaggggtaacagggatatatgtgtaatttatttaatagctgtgccactgcttccttaattccagaaatcttgttccagtatggtgagggcatatagttacctagagaaatgaggtatatctaaagtatcatgggagaatttagacagaattacttatgatactgttggaactgttgctggttttgtttgtttatttgagctatttcgaaactatttttttctctagaattaagtgctgagaatccatattgagactggttcgtgtaggtttccctgtgttgacttgagaacacatggcttttgaacttgattacaatttgggggtctttgaatcttgattacttagctatttttcctcctgctttgttgaagtattgctggatattagtttgtaaagttgttaaaatctgtgtgtcttatttttgatacattagcttttttgtgtatattaaggtagttttatgtacattgaaaaaatgaacatgtattttaatttttctaccagcaagttgaagtagatgcacaacagtgtatgcttgaaatcttggatactgcaggaacggtaggtaaaactaaataccaaagtatatacaccgtttgtacagtattgacttcataaatgctagtactctatagacaaatattagttaagcttatttaaaagtactgcttgcagccggttgtagtggctcacacctctattcccagcacttcgggaggtcaaggttgctggatcacttgaggtcaggagttcgagaccagcctggccaacatagtgaaaccccatctctactaaaaatacaaaaattagccaggtgtggtggtgggagcctgtaatcccagctactcaggaggctgaggcaggagaatctcttgaacccaggaggcagaggttgcagtgagccaagactgtggagattgtgccactgcattccagcctgggtgacagagcgagactctgtgtcaaaaaaaaacataagactactagttgctaaactttaaatctttttgttgttgttccgttgaatccttaattttatattggccgggcgcagtggctcacgcctgtaatcccagcactttgggaggccaaggtgggtggatcacttaaggtgaggagttcaaggccagcctgggcaacacagtgaaaccccgtatctactaaaaatataaaaaaaattagccgggcgtggtgttacacacctgtaatcccagttacttgggaggctgaggcaggagaatagcttgaacccgggaggcggaggaagtatattgcactttttgtaattgcagtgggtcagttattgaaaagtttagaaaatgtgttagaagaaaaattttcagtctcactagtacttttaaaacaatatattaccatatttcaaataatacaggcatacattcattcatcagcagctgtgtgaaatattttgattgagctgggtatgatggctcatgccttgtaatcccagcactttgggaggtcaaaggggggtggatcacctgaggtcaggagttcaagaccagcctggctaacatggtgaaacccgtctctattaaaatacaaaaattagccaggtgcagtggcaggcacctgtagtcccagctactcgggaggctgaggcaggagaatcgcttgaaccctggaggtagaggttgcagtgagctgataacacaccactgcactccagcttgggtgacagagtgagactccatttcaaaagaaaaagaaatattttgattggtatctgttctccttcaacgtatttatagacaaactaaatttgtaggtatgtgaagatgaagggaagatttgttctcggtgtatggtattcattcagctaatgtttgaatacctgatacatgtcaggcactgtgttgttaccttcaaatgctcacagtctagcaaagaaaaagtagtgtgggaaaatgggatggtctagatcatgctgatggagccctacagaactacagcatttgagtcatagctaatagattaacttggcagatacagttggggtgctttatacatgatgatgtattttaaaagctgcctttagtaacttttggggacaggatatttctgttccacttgagtatattttttgtatataaatcgactttggtgtattgtttttaaataggaaacctatttccagctgggcgtggtagttcacgcctgtaatcccagcactttgggaggccgagacgggcagatcacaaggtcaggagatggagatcatcctggctaacatggtgaaagcccgtctctaccgaaatacaagaaaaaaattagccgggcatggtggtgtgcgcctgttgtcccagctactcgggaggctgaggcaggggaatcacttgagcccgggaggcagaggttgcagtgagccgaggtcgcgccactgcactccagcgtggtgacagagcaagactccgtctcaaaaaaaaaaagaaactaaaatgccaattttttcaaatagtatcttgtcatagattataattttaacaaagttacataatactacagtattcttcattgagctataattatagactgtgaaaattgtaaaaataactgtcaaaacattattgttttttaacgttcctttctttctattgtaggagcaatttacagcaatgagggatttatacatgaaaaatggacaaggatttgcattagtttattccatcacagcacagtccacatttaacgatttacaagacctgagagaacagattcttcgagttaaagacactgatgatgtaagctgacttccaaataaatatattttatttcaaaaccctgattataattgtttaagtctaaatttaaattcattttaaagcttgtgtattttggttggggggggggtgttggtttttttaaactttttccttgaaaggcaaaaatacccatacatgttttcaaatatatatcatgtggaaagtgagaaatttcctcctttgccattatcctgtgaaaattaaatgttacacccttccttttttttttttcctttgagatggagtcttgcactgttgcccaggctgaagtgctgtggtgcgatagctgtacctcccgggttcacgccattctcctgcctcagcctcccgggtagctgggactacaggcgcctgccaccatgcccagctagttttttgtatttttagtagagacagggtttcaccatgttagccaggatggtctcgatctcctgaccttgtgatccgcctgcctcagcctcccaaagtgctgggattttaaaggcaagaaatacattagattctaacattattaatttaggtgccccttcagagtctaccataatggagtttaattcctcatcacactaaatatagcagtggttctcaaaattgattttgcatcagaatcacctgtaggaccagttaaaacagattgctgggctgagatctcagagcttctgattcagtaggtcagcagtaggacccaggaatttgcatttctaacaagtttcgaagtggtgttggttttgctgatctgcatactgtaagaaccaggctgggcatggtggctcacacctctaatcccagcactttgggaggccaaggcgggtagatcccctgagctcaggagttcaagacctccctgggcaacatagcaaaaccctgcctttaccagaaatttaaaaaaaaaaaaattagccagcatggtggcgcgtgcctgtggtctcagctatttgggaggctgaggtgggaggatcacttaagcctgggaggtggaggttggcagtgagctgagatcacatcactgcactccatctagggtgacatagtgagaccctgtctcaaaataaatacataaataagactcattgtactgcagtttaattttagcaaatattgtgagagctgggagacacccatggtaaatgcttttattttctggacttctgaaacaagggaatttggggggaccctacataattacagcaacctcagggaacattttttaatttgtaaatccatttaataagtggcttgatttttagtaaattttgattggcttttttttttttttttttgagacggagtctcaccctgtcgcccaggctggagtgcaatggcacgatctcagctcactgcaacctctgcctcccaagttcaagcaattctcctgtgtcagcctcccaagtagctggaattacaggcgtgtgtcaccatacccagctaatttttgtgtttttagtagaaacagggtttcgccatgttggccaggctggtctccaactcctgacctcaggtgatccacccgcctcggcctcccaaagtgctgggattacaggcgtgagccactgtgcctggccttgattgacttttttaatacaagactatgagaaactaaaaattctattttgggagccttccgtccattatgataaaattttaaggttttttccccccatctctcataacaggatcatagcttgttttctcaaaagtttatgtaaaagtgtcttatttatgtctacattgactaggttgtgttcattttacttaacatatgagagttttctttctctcttttcttccctttggagttatcgtttgcatctccatgaaaagagaaggcagtggagataattgacatcaaagttaatacttatgtttatgttacagattaaattgttaaggctgtaaattttattatacattatttaatattttttgtggcatatgaaaagtaattcttagatttgactcttagaattcttttgatttgaattcatatagcatatttacttatttatttttactctcacaaatgtatttttaggttccaatgattcttgttggtaataagtgtgacttggaagatgaaagagttgtagggaaggaacaaggtcaaaatctagcaagacaatggaacaactgtgcattcttagaatcttctgcaaaatcaaaaataaatgttaatgaggtatggtcaaatatacttaaaatgggtcttcatttgaagtacaacattgaagatgaatggaaaatgtcttaaccccaagttaatatgtactcagggtaatatgttgatgttacaggcaaaaaaaaaaaaccctcatgttaaatgtatctatgtagtaaataaacaatactatttcagtctctattaaatacttgtacattgatatttaccatgaaaaaggaagactggacagaaaatacatggatagggaagacagattaagacttcaggtatatgaaggatgttatatgaaaaatagagtaaaattccgaaaagtatgcatggttcttgaaaggctccaagtcatgttgtagagcaaaaacttacagtttttaaaaggattttttctttgtgtgatggtaaatgttctaattgaactaagttaagatctctgcagctccttcaactaagtattttaaggagcacaatattaacactccccaaaaatttgagcttggcagttataacacctgattttattctcattccttagctgaacaattctgggcattaatttatatccatggaaatttctgttttttcaatttacttttttcattgggggggataggtgttcctcctgtaaattaaaacaaattattgtatttgcagatcttttatgacctagtgcggcaaattaacagaaaaactccagtgcctgggaaggctcgcaaaaagtcatcatgtcagctgctttaatatactaaatgcattgtagctctgagccaggtatgttcacttatctttcctctaacttttaatcactcaaccttattaagggcactctgtcatgaaagcaagtatagacttctttttgttggttctgaaaaataaatggtttatttttataagatatccatgagttagtatgctatcttattaattatttacttatcatcatgagtaaagtatttcacataagtattctttttttgagatggagtttcactctgtcacccaggctggagtgcagtggcgcaatatcagctccctgcaacctccgcctcccaggttcaagcaatgcttctgcctcagcctcccgagtagctgggattacaggcacgtgccaccacgcccggctagtttttttgtatttttagtagagatggtgtttcaccattgttggccaggatggtctcaatctcttgacctcgtgatctgcccacctcggcctcccaaagtgctgagattacaggcgtgagccaccactcccagccaaccccgtccctaatttaaaacacacacacacacacacacacacacacacacacacacacacacacacgtgcgcgcgtgcgcgtgagccaccgctcccagccaaccgtccctaatttaaaacacacacacacacacacacccctgacatgttcatcatgtgccagtcacacacacacacacacccctgacatgttcatcatgtgccacttttttttttttccttcaacttttaagttccaggatacatgtgcaggatgtgcaggtttgttacataggtaaaggtgtaccatggggtttgctgcacagatcttgcatcggtacctggcacatagttaacactcaactattagctgctgctgtttgccaatgataatggtttcctcttcagctgtcattaaactgtttattgttaaactgttaatttattcttaagaacctttgacattcctgactcttatttcttcctatgttaattgactcagtgctgccatagcactttgattctgcatcttttcagagtttttattcctgccttccatctagggctttctgtttagtggtatatcctctcattctaatatcctataattcctgaccacatgcccattcttagcagcacacatgtgcttgagctcacacacttccatctgtcctttttaatttgcaacagtctgccaggatttagaaaacttgattgcaaacctcattcagactcagaatgaggacctaaagttctaggcatttgtgaaaattatttcaacagccacatatgtattaacaactcttctggagcttgtaacaagtctgatcaccagaaaaatataatagggaacatttttttagccgaggcatgtatgcagaaaactattcaaagtacatatttaacaattctaagtttactttttaaaatctttaattacatgtgattttagtgtaataccacctttttctgacatcagtcttaatagaatgtttaaatatggaattagaaattatataacgtgattgtaaatctgtaaaacaccatcatgaaataaattctatttgtctgctctgaacgagctttttagccactttcattgaaagagtgaggaagaacttgattatctgatactagaaaccttggttagatgtgcattctatacttatgatctaattctaggagtacattacgattgtgtaaacacaggatcacccagtttgttaatattgctatctgacttttcaatcctaattctaataaggttgacttgactaacaattttaatgtgatttttttcctttttaatccttggaaggtaatgcacaaaaatttgcacaaaggtactttccctttctgttcctaagattttcatttaactgactttcaagagggcagcagaatagacttcatctttttggaatgaaaaggtctgccgtgaattgtggtatgttgccactaatgtaatgcctagaacaagagcctagattatattcatttctaacacttttaagactgttttcttaactgtttgcttttgggtctttactttttctagcccatgtttttaattaatttttttccttttgacaggtctgaagaactgttgcccaattcaacagtgccagcattccaactttgttaaacctaccaacatcttaaatggactttcctgtggtggtaccctttaagaggcggatgaaagctactatatcagtttgcacattctaatcactttccagtatcacaagagagatttttacttatataatagtcctagagtttgcagctggtaaaaccagaggctacatccagtattactgctaagagacattcttcatccaccaatgttgtacatgtatgaaaatggtgtactgtatactttaacatgccccatactttgtattggagagtacaataatgtaaatcctaaaagcaccactattttagcataataaaagaaagtccaaagagctcctatatagactactccagataacttcgcttctttgatacttgtagcttattgtaattttttttaagaaattcaaggtcattattattgtacaaaataagcgctttgattaacacagctatatagtttttttaatttttaaaaaacctgtggagacggtgatcttgtctttaaaacatgatagtcctttcagtataatgtcttagattaaagacgttgcctttaatatctgttgggaaggaaatgtccagacttttcaaatctcttattatatgtttcctttttttgtttacatagggaacaatgtttatagtcgtgtgtacagtgggggtctacaacaagaagtgtatattttcaaacaattttttaatgatttaacaatttttgtaaatcattttcaggcttctgcagctgtagattctcactgtgaatcccttgcttgctcatgcataagtgtatttgcaataccaaatatacaggtttagtatttttgcctgttagtgattgtttcacatgtgtaacgttttggttgagatgttaaatggtggacgagtactgtggatgtgaatgtgggaagtaattttaatcatatgtaattggtcacaaggcctaatttgcagtaactattgctgttttatttaacaatgccttgttgctttgtatgcattaatgtttggatgtaaagattgtgtgtctatccaacagggagccacagtatttaaattgaccaacctaatgttacaactactttgaggtggccaaatgtaaactaaaagccttaattaaagtggtgcaattttgtataacttagcatcagtagttcaataaatttggattgccatgcaagggcttgcattataattacttgccacttgaatgtgttttgtgtaatgttttaacagtgctagtaaataaatacgggtttaccctggttttaattgtaat

SEQ ID NO: 193 - DNA, 49769 bp, Homo sapiens; identical to SEQ ID NO: 192

SEQ ID NO: 194 - DNA, 49769 bp, Homo sapiens; identical to SEQ ID NO: 192

SEQ ID NO: 195 - DNA, 49769 bp, Homo sapiens; identical to SEQ ID NO: 192

SEQ ID NO: 196 - DNA, 49769 bp, Homo sapiens; identical to SEQ ID NO: 192

SEQ ID NO: 197 - DNA, 49769 bp, Homo sapiens; identical to SEQ ID NO: 192

SEQ ID NO: 198 - DNA, 181880 bp, Homo sapiens
cttttgtaatatttgaaaataaaccaactttatttgaatcagtcaataccaatcaagactggaacacaaattggtaattggttcagattcatgaggaaaacactcagctgtatcttcattaaaaggcattttacatttattaaggcttgaaagcaagtcctgttattcatcaccatagttaaaggtctcgagaaaatcaagtaactatcatttggagtgtctttgtaaaatgaaacacttgttcttttacaaaagctaagcatcttttgttaagctagttaactccccagcttataaaataggacaacgaggtggccaggaaagtaagacaaattcaaacatcagctggataatttatattttaaatatatgtatagtcaatattgtgaaatctctaactctacataaaatacttcagatgactggatccttaaaagtacattttaccaaaaacagattgcttctatagaaacacagaatagcccaaaccttatattgaggcaacgtattttatttatttttggttgcaagaaaggaattggatctatttctttaacgttaaatgaaattatgcacactttggatcatacataattatgaatcgaaagtatcctgacactaagctgggagatgcatactgacaaaggggaagaatgtgtgttgatgaggagggcacatgttgcttgatttgaatgataaagagaaatggatagaagacaatggggctgtgtgcagcaggtcctgttcgcttaagttttcctaacatcagaatcagggtgcttcacatgcacatgtctttctctgatgctttcttaagattctccttaatgtcatttaaaaaaataagaaagtgatcccttgggaatcattgtacttagttttaaccatgagttaacatttcctttttccaaggaggatgacaccagcatcttgattcaccgtgcagttgagatggcccctggccagtgggaattgaggcgagtcacagaagtacttaccaaatactcacctgctgcttctagtttaatttaattttagacacacactctcacagtgatgctaaactctttacaagatagacccgcagcttcctgcctctgcctctctcttagttctatttgtccaggccttgctgatttctgggactctcatatggtcaagatctatttcaggcatgacctatcttatgacagttctaagatgcttggtattgtctgtctgtggagtggccatggggcacagaactgtgaagagcttctgttgtttcatttgataagggcctggaaagtcagcctgggaaaactcgcacttggtgtggcctttttctgataagatcaagacttcactggccccaccagcacaagaagggaatgctgaggacagggccatttcccaagataaaactagtttgggatcgtgtggccaaataagctgatggactctgtttccgacatttcagctcatttgcttagtgctaggtcactctacctctcgtttaaaagaatatagctatgctcacatctgtgactctgaatttatcaagcatttgactttctttatcaggagatgaagaaactgtgctttggatccatcatgattttacttatccagcttactttttacagttattaaaatcttactcaataccttctctctgggccaaactcagaagcaggcattgctgactagacagtgaattcaactcagtcattctgagtttgactcttgcttctgccttcgtctcccactaccctgcttcccccacccccaatagtgctgtgcaagtcaaagaagataaataaatacaaaataaaataagatctcaacacaaatacatcccctttctgtgccaccaaaatgctttctgagcgatttgtattcattcaggaccaatgaaaaggaagcctcctaccctatagctgtatagttgtggggtcccaactgcagaccctcccgtgctccctgagttgttcttgggacacctaaggacctcaccacactgttgctgagacatgatgtgctgcacatatgataagaaggccagacaggctgaagcatctggagaaagatctcttttgaaacaaaaaaaaaaaggaaggtaatattaatattattgttactttaatataccataataaatctagtcataagacaccataactaactcttagtccatagtcacttgcattatatgataatccagtgctgaaatataaagaaatttctgaattaagtacccagaagtgccttccttctgtactcctccctctctttcaaatggctatcattgatcatataacacccccacctccttgtcttaatatatttatctctgtaaaactagctcaaccacagaagggacatctagaaacagcaatattgatttggtttggcctgtttgtttttaaggactttccagttgctgaattctgaacatccaatccgagtccttggaattctgcagacttctctggggtggagtggcctcaccggaggcttggttctgttttctctgtggcaattggctatgattcacagatgtgtttccagaacagcccaactgtgggtctcagggaagtaaactgcctcttaggtcatcctgcctgtgctgtaaattcggggaaggatttctgagtacagcaggatttcacactaattaaaaggccttcgggatcatttcagccctcatcccccaggaggccagtttggggcttttccctacagtaaaaaaggactctttcctcaccagttctccttgttaaacatctccagggcacaatttccagggggacctggaaaggttccttttgaggtggaaatgaatcaactcattccgccttttcaaagctttctcaggcttataaagtgtcctactgagaaagttcctcttcctcaatgggctctaggagacctcctgcttcctctcctctgatttgatcaatgggttactttttttcttcagagatccctggaggcaggtaggtccagggattgcttgggttagaatttgttgatatttctatggaaaggacccgtgctatcctgcccttgctgagaaatgagccaagtccaggggctttccagcacttgggagcctcaccctttaccagcgaacactatagaagggggattgttgaaggtaagggcctgtggcaaatggattttctcaccgggcgttcactgggagaaggagttgatgagtgcatttttcttagtttcctctgcacaggtccccaagctcaggctgggtaagctttttaggagatgaaacttaaggagaatgacaaaagagtgaaatattagcttaaaaatttttccttttttttttcacctggcagttgagtcagattgtaggaaaattaacccagatgggtctacatttttcttcaagttcaaaccacatggtttcctagtcagaaagtctcatggactttcttcctaaggtgttctatgatcagaccacctcctaaatgtggcttttacccattacaggctacagttgaatcaggcaggagcagctgctggagagcacccagccgacagacctgcattccagaagcagcttggagaaactgggaagacatttttgacccattcttgggtttttactgtaaggttagcagttacatgatgccaccagtccaagacttagatcatgagagaaggcctttttaaaagtttaccagggaacatcgaggctcataaagaactcttttgtcttcacccatctctcctcctcccactcccatccactttctcatagctcaaaaaccactcattggtaagcacagtcaaacccaggcctgtaatcacctctgaaacaactactcctaagcaagcaaaccccatggctggtagaccccgtgggtattttggcatcaacactgctcccctcccctcccatcccagtcactgcagtttagaattgcatgccaatttccttttctggcagggcctggacggcatggaagccagggacagcatgggccaggtgcgcagcagcagcagcgcagcattcctggcactgcaacaaactgagaatgtgtctcaagtgactttccagtctggcccttagtgcccaataaccagagtgtcagaagtagtgagactgaagctgtgtttgccagacacccaagtccatagccagctcggtactcctccattcactctctctgtctcccctaatggggtaatagatctctttctaagaaggatgaagatggcgtttgtccttggccttgtaggtatggacggagaggagggtagaaaaggagttggtgttgcatgtttctaaagcatctgagaaggtattttgatattggcagaagaagctagtggcaatcccatatgtgggctctccaacactgactgaccccaaacatgctgagcccagatcaggctggccggccgaaaggtggactgtgtctatcatttctgctagattcctatgtgaggaggccagggatggtgctgaccttcatgaaagatagcaggctggagttcccatgataccagcaagatgaggcttgattataaaaagtgcgcctcaaggcagtgatacagaggagtctatgaagctggagtcttaggggagtggttgagtccttctgcagcggggatggggcaaaatggctgtgctcaggatcggctgaggcgtttggcgacatcagcgtaggccaactcgatctcactgtcagctgcacaggtgttggtgaactcatcacgggcataggcgttcttgaggtaccgccacaggcctgtcatctcagccgggatatcatagttgcggtatttcttggccacaatctaaaacagagatggcaggacagaggtggtgtgaaggcatgaaacaaatcattagaaagtgttagtggccgtcccagtgtgtgtgcactgcaggaaacctccgtgcatcaccacgggccatcagtgatatgtttgaaatgcaaggtggcagtgctgtcttctttttgttttgttttaatttaatttcttaagtaaacataatttgccctttgacctagtgtgtcaaattctaggaattttttctcaggaaataatcatggatggatataaagatttacctacacaattatgatcccagagctattttgaataacaaaaatggtgcacagcgccaaagtccaacaatatatgaatacatacattatcttacacaaataaaatgtcatagtggagggacattaaaaatgatgctgctaagaaaatctagtgatctggaaaactctccaagatagactattacatttaaagttcaagtataatgcatttggagaaacatgtatgatggctagatgtctatatacctatatattaccagtggttatgtctgattgatagaattaccaacaatttttcttttcttctttctcttattcactttgttttacacaggccagtttttcccttctttatttatagaagggaaaaaaaaccatgaaaagcaagttagatattggaatgtatatgtaggtttagactatgacataaaagtaagcaaatactgatttctgttctcgccctggtttgccacagtcaggggggatgtggactggagagttctggagaagtggtatttatgttgagagaaacaagagcaaagtgattaaaagcatgggctctggataccaactgactggatttgcaatcatggctccacttagcagctgtgtgacattgggcaggttacttaacctttctgagctccaatttctttatctctaaaatggatataataataaaacctactttggagtaataaattagttaatacacatcaaatgcttagaggagtgcctggcaaatagtaaatactcaataaacatcaagtattattataattcattgagacctagcttgtacccatttgcatgcattttcttaatggggacagcaggatggtttctttaatgaggtctctctagctgcggcagcttcatggacctgtgacctgtgcagtctcaccttgcactcagaagagccctgctgttgatttaatgctctggggtcaatgtgtggaaattcttaataatttttaaacagggcccccctgttttcactgtgcactagggcctgcacattagctggtcctcctctagcccttccaggctaggctagggtaggggtaacaggagagtagtatcacttctgactcccctccctccctcttttctgtccctttccttccctccctactcccttccttccttccttccttccatccttcctctctctttctctcactctctctctccttctcttccttccttccctcttttttttggggggatacaagggggtacatgtgcaggcttgttacctgggtataacgcatgatgctgaggtttggggtatgattggtcctgtcacctaaataatgagcatagtttttctacacttgccccctccatccctctgccaagtagtccccagtgtctattgttgccatctttatgtccgtgagtacctattgcttagctcctacttataagtgagaacatgtagtttcatgttttctgttcttgcattagtttgcttaggataatggcctccagctgcatccatgttgctaaaaaggacatgactttgtttctttacatggctatgtagtattccatgatgtatatgtaccatgttttgtttattcagtacactgttgatgggcacccaggttgatttcatgtctttgctattgtgaagagagctgtcataaatatatgaatgcatatgaaatttttttggtaaaacagtttattttcctttggatatataaccagtaatgggattgcttggtcaaatgatagttctgcttttagttctttgagaaatctccagagtgactgaactaatttacattcccattaacactgtataagtgttcccttttctccacagactaaccaacatctgttgctttttgactttttcacaatagccatcctgactggtgtgagggaggtgtctccttgtgcttttaatttgcgtttctctggtgactggtgatactgagctttttttttttttttttaatgtttgttggccacttattatgtctttttttgagaagtgtctgttcatgtcttttgcccactttttaatggtattatttgtttttttcttattcaattgtttaagttccttatagattctggatattagacctttgtcagatgcatagtttgcaaatacttcctcccattctgtgggctaactgttcactctgttgatagtttctatgtgcagaagctctttagtataattaagtcccacttgtcaatttttatttttgttgcaattgcttttgtaacttcatcataaattacttcccaaaactgatgtacagaatgtttcctggttttcttctaagattcttacaagttgaggtaaatctttaatccatattgagttactttttgtatatgatgaaaggtaggggtccaatttcattcttctgcatagggatagtcagctattccaaaaccatttattgaataggaagtcatttccccattgcttatttttgtcaattttgtggaagatcagatgaccgtaggtgtgtggctttatttctgggttctcttttctgttccattcatctatgtgtctgtttttgtacaagtaccatgttgttttggttactgtagccttatagtgcagtttgaagtcaggtaatgtgacacctccagctttgttctttttgcgtagggtggctttggctattccggctcatttttggttccacacgaatttttagaatagttttttctagttatgtgaaaaatgacattggtagattgataggaatggcattgaatctgcatattgctttggacagtatggccattttatcaatattatttcttccaatttatgagcatggaatgtttttccatttgtttgtgtcagctgcaatttccttaagtagtgttttatagctccccttgtagagattttaactccctggttagatgtagtcctagatattttattttattttatttttgcagctattataaattggagtatgttcttgatttggctctcaactttaatattgttagcatacagaaatgctactgatttttgtacattgactttttttttttttttgagatggagtttcgctcttgttgcccaggctggagtgcaatggtgcaatctctgctcactgcaacctctgcttcctggattcaagcgattctcctgcctcaacctcctgagtagctgggattacaggcatgcgccaccatgcccagctaattttgtgtttttagtagagacagagtttctccatgttggtcaggctggtctcgaactcccgacctcagtcgatccgcctgcctcagcctcccaaagtgctgggattacaggcatgagccactgtgcccggccacattgactttttatactgagactttactgaagttgtttatcagttccagaagccttctggtgaagtctttagggtttttgaggaatagaatcacatcaccagtaaagagagagaatgtgacttcttcttttcctatttgtatgccttttatttctttatcttgcctgattgctctggcaaggacttccactactacattgaataggagtggtgagagtgggcatccttgtcttgttgcagttttcaaggggaattatcccagtttttgcccattcagtaagatgttggctgcagatttgtcatagatagatggctcttattattttgaggggtgttcctttaatgcctaatttattgaaggtttttgtcatgaagggatgttgaattttatccaaaggttttctgtgtctattgagatgatcatttcatttttgtttttaattctgtttatgtggcgaataacatttattgatttgtgtatgttgaaccaaccatgcatcctaagaagaagcctatttgatcaatgtgaattaactatttgatgtgctgctggatttggtttgctagtattttgttgtgaattttttgtgtctatgttcatcagggatattggcttgaagttttcttttttcattgtgtctttgtcaggttttggtatcagggtggtgctagcttcatagaatgagttaggaaggagtccttccttgatattttggaatagtttaagtacgattggtactggttcttctttttatgtcaggtaaaattcagctgtgaatccacctagtctggggcttttactggttggtaggtttttttaaattactgattcaatttcataactcaattagtatgttcagggtttcaatttcttcccaattcaatcttggaatattgactttgtatactgaacctttactgaagttgttgatcagttccaggagccttttggtgaagtctgtagggttttcaagaaatagaatcataatcagtaaagagagaatttaacttcttcttttcctacttgtaggccttttatttctttctcttgcccaattgctctggacttccactatgatgttgaataggagcggtgagtgggcatccttgtcttgttacagttttcaaggcaattgaaaagtgtatttctaggaatttatccatttcctctagattttctagtttgtgtgcatagggatgttcataatagtctttaaggatcttctgtatttctgtgagctcaattgtaatgtcttctttgtcatttctgattgtgcttatttggattttcttttttgttgttgttgttgttaatctagctaatggtttatggatcttctttatcctttcaaaaaaccaacttttggtttcattgattctttgtatgaatttttgggtctcaatttcattcagttctgctctgattttagttatttcttttactatactagctttgaggttagtttgttcctgtttttctagttcctctaggtgtgatgttactttgtcaatttgagatctttctaactttttgaggtaggcatttcgtgctataaactttccttgtaatattgcttttgctacatcctagagattttggtatgttgtgtctttgttttcatttatttcaaagaatgtttttacttttgccgtaattttgttgtttacccaaaagtaattcaggagtgagttgtttaatttcatgtaattgtgtgattttgagacatcttcttggtgttgatttctatttttgttccactgtggtccaagagtatgattgatataatttctattttttttaatttattgagatttgctttatgactgagcatgtggttgatcttggagtatgttctgtgtgcagatgaaaggaatgtatattctatggtcaatgggtggagtattcagtagatgtctgttatgtccaattgtcaagtgttgaatttgagtccagaatatctttgttagttttctgcctcgaagatctgtctaacgttgttagtgagttgttgaagtcccccattattattgtgtgttgttgctaagtcttttcataggtctagaagtacttgttttgtgaacctgggtgctccagtgttgggtgtgtatatatttagaatggttaagtcttcttgttgtagtcacccctttactattatgtaatgcccttctttgttctttttttttttttcactattgttggtttgtggtatgttttacctgatatgagaatagtgacccctgctcttttttatgttccatttgtgtaatagatctttcttcagccctttactttgagcctatgggtgttgttacatatgagaggggtctcttgaagacagcagatgagtggctcttattttttatccaaattgccactctatgtctttcaagtggggcacttagatcatttacattcaaggttaatattgatatgtgaggttttgatcttttcgtgaagctgttagctggttactttgtagtttctattgtgtgcttgctttatagggtctgttggctatttacaagtgtgtttttgtggtagcaggtatcattcttttgtttccatgtttagagtcccttaaggatctcttgtaagtatggtctaatggtaataaattcccttagcacttgcttgtctggaaaagattttatttctcctttgtttacaaagcttagtttggtgggatatgaagctcttggttggaatttctttctttaagaatgctgaaaataggccctcaatctcttctggcttgcaatatttctgctgagaagtctgctgttagcctgatggggttccatttgtatgtgttctgacctttttctctagctgcctttaagacttttttctttggcattgaccttggacagtttggtgactatataccttggtgaagttcattttgtatggtatctcacaggtgttctctggatttcttgtatctgtatatccaccttctaccttgctttcattttcagagagggccctagaccattgaccctgggatcctcccattcagagaagccccagatcagtcactctgggcttttgtctccattttggtgctggtaatatgcagagtttcccagaaagttatgctgaagtgaaggatgatgatgacttgatggatgaaaaactcactgttgcagacatgttcacagacatctgggaacattttttcccctctatgctcctaggccagtgttgaacttctgttataacactgagctataatctattctgaatcatgattactgtttcagtaccctttttttttctaacttgtgggcagtgtaaggatagcaatcacaggttcttcacttctgtactccttgataatctcaataatgatgttgatcagaggaatgataataacaaacatttattcactgtgtgctctgttccagggactgctttaagtactttgcaaggtacttaaatctctaaataatcctataaggaagaatctattatattcccatttacagatgagaaaagcaagacaaagggagattaaataggttgggattcaaagtttacaatcttatctgtacatcagacaaggttctctagtgtcaagtgtaataaaataattttaaagactgaagatccctagcaatgagcaaactgaagctacaagagattatgtgacttaatgttacatgataaattaattaatttaaccaatatctattgagttaccattaatatttattacagtccttgctttataatccacagttctttctactttactactcagccctacatagctgataaagcaatgggtcggtctactcagaatccctcatgttccagccattaatttactgttgcttgtctccaaacctactcttctatttactattttttgtgatgctggggctaggactgagcagatcacatctcttctttgccagtgaatcctgttaggttctgccaagaggagttactggagagagccagcaaggttggaggaggagaagggagggagaagcccatgcttttcagcttcctctttctgtcagagtctccatttatttctgggagcagcagctgaatccagtttgctattttgtcaatactcacaggaccacttcatcatacccacgcagagaggccagcacatagcaggaactctgctttagaggctggatcccagccaacctgagcttggaccctggcaccagctgagcatcactttcaccgacattcagctctgcagggtccctcatctacagagcccctaagtttgtaagttttaataattccaacctcttccctttgttcctcctgccctaggagtagtagctgcctcttgaaggtagaacctcctagtatattttgcctttccagttctttactacatagtacttccttaaattctctctgttaaaataactggtttggtgtgggcaccaaagaagccacccccacactgttctgtctggcttaggtaactacaagcaagggtgatgaagtccgagtcctttgataaagctctcacaatgagagatgccaccacgatatctccccagtccctttctgttcactgaaagatgatgatcccttgggttgggccaagttcctttgagaagaggctgtcttggctaagagcaaattcatgcaggagtggtggcctgaccaagagaactggctggaatttatcagagtggatgaaaagggtctccaataagataaagggatccaaaagtatttttcacagtgacacactgattcatagagtagcctcaagtcatttcatactgaaattttattttcaggattttaaagggcagaatgttagtttcaatacagcagaaatgcaatttgtaaatatatacttctattgatgttggtgttccccttcttgtttgtctccagggctgaacatcgtcactatgctaggcaaggatcccagtgagcaaggaaaggcctgcagatgcctctcccaacgaagacctgtgcaccctgggccttggctgctgagctggtcatttcttcacacattggcttgactttgggagatgagaactaggagggggccagacaatgaatgttcaagccaaactctcatggagagcctgggccagagcaactctgcttccagggatggagataaacctgaaagcgagccacgcaagaggagagtgagcatgaaagcagcaagggggtaaggatgcacacggagatctgacgttcgcagggacttccatgctcatgttctgaatttgctctttcatatgaaaacagttagctcccacagcccagattaagttttggcatccgaagccaaactggaggcctgacttggcttccccttcgctctttgtgaactttagaggtttgccaggtttctgggatctgataagctggatcagcagaaatccaaagagataggggccaagggctggcctttgttctttcattggccatcttctttttgatctccagcttctctgggttaaccacccactgaattttctccaaggacagggcttcactgagtaatttaaggcaggtgggaattgaggaaatcacaggatgaagcccaaggcttgggagattcatttgtttgctttgttcaacaaatggtttttgagtggtagtgaatacatgtttgagcaagagaaaaggaaagaaggagggaaagaagaaaggaaaagaaggcaagaaggaatacaatccacttctgttcttctaggcatgagaaaaatgaattccaaaaagattaaatgatgtgcctcagctcatgctgctagttggcagcaaatacaggaccggaactcgggtctcctgatctttgcattgtatcactctgacacagtgtgactgagctggaattatatcatccctttcagtggtacttgttcctaaggagaagaagaataaaggatgatgggtggggcatgcagtagttaataacttcaaagagacatagattggctggacctacaagtgactattggcttggccccaaatccaaaatgttcttttctaaataggttgtatttgcccactccatttttatgcatgattccctctcagtcttcagctctaaggcatacggaaacaccagtgtacacacaactgagtgacttcagctcaagctggtacatgctctggttggagaggagatagcatttttgactcgggacttgagctgaaaaataataggcatatactcagctgacagatgattgaatctgagtcttctcagtgaagcatagaaataaactggatatcgtaaagacttacaccaggtgatcaaatgatcaatcaatgagtatttattgaatggccactgtgtgcccaccatcacactttaaaaagttcctttcctcacagagtttgctgtctggctgagacagtaagatataagcatgcgtaaaatagagcacagtatggctatctgatactaggctgacgagggtcaggaaagaatgggggaagaagtgctcattgacagagcttagggggatacaactactgtcttcaaatgaggtgaaggcaagcaaagctgttctctgttactctagagaaaaaatggatagcagggaggcatgcttgggctcattgtaaagaacaatgatttaataatcagagctatctaacatggtagggctggctcattaagcagagggctcctcgttctcagaggctgcagtcacagcttcacagaagcctgtcacagaaacagcagaaagtggtccaggttgaagtgggagattgttttggatgacctctaaatgtcctttccaactctcagattcccagggtttgttatataggagaggatgacactacatgctgcaaatggttagtaagtgcaatgatagcaagaaagtgacatcacttcttgcaacctccacctcttcatttgatagatgaggaaaataatgtgggctcaccttaggaagttgctggaggaagtgagaaggtgggtctgtgcacaaagaaaaaatgcatatgagggcacatttaatagagctgtaggggtgtagccagggaaatcctatgaggaagaggcctttggagtgatatgactgtatacaacaacgataattgcgactattacacatattaagcccccacaatatgccaagcactttcacgctgtatttactcttccaccaacacttgaagtaagcaatatatgcctattttataaatgaaaactgaagctcaaggaggccacacagccaacaagcagcagagggtgaccttgggtccttattacctgacttcagggtccaggttcttgaccaacaggtggtactgtccttgactcatccacacaggtgacctgggcctaagatggagctggatcttgcaggcccctgtgggtagagctctcttaccttgaccacatggagcttgggcaacagattgcagtcagccagggtcagctcatccccatccaggaacttgcgccgggaccccttgtcttccccacaagtgttggcgtcaatctcctctggtagaggggtgttcaggtagtcatccaatttctttagagccttggttaggcctctttcaagagctggcatgaaagagtaaaagggcctttattcaaacttcttgccagtggatacagtcatagggtcttcagagtggagtagctcatctagaatcctgtccccttcatcacactgccagctccccacacactgcagaatacctggaaaccattaacacaatgcagtagaagtgtactaaataggctgaaaaggcaaactctaaccaaacaataaacactagctaatcttttgctttgaaaaaaatacataaatatagaaacacagtctgggtgtggtggctcacacctgtaaccccagcactttgggaggccgaggcgggcagatcatgacgttaagagatcgaaaccaccctagccaatatggtgaaactccgtctctactaaaactacaaaaattagctgggcatggtggcacgcgcctgtagtcccagctactcgggaggctgaggcaagagaatcgcttgaacccaggaggcagaggttgcagtaagtgaaataatactagccaatttatttatttatttgtttgtttatttatttttgagacagagtctcactctgtcactaagctggagtgcagtggcgtgatctgggctcactgcaacctccgactccctggttcaaacgattttcctgcctcagcctctcgagtagctgggattacaggcacaagccaccacacccagctaatttttgtatttttagtagagacggagtttcaccatattggccaatatggtctcgatctcctgacctcatgatcggcccgccttggcctcccaaagtgctgggattacaggtgagagccaccatgcctggccaatactagccatttttttaaaaagttttggttatctataatttgctaatattccacatcaacctacatattacatttttaggaagaaaaggctattaaatgggtaaatataaactatatagaagttccaagacaaagatatgcatcagatattgtggaagtattaactatagctaacccaacccaagaagagttggggacaaggccttcagggggacttgacagggggaatagaacagccctttttgatgtcacccccagagaagtgatgggtaccagggaagaacacttgggttactctagggaagcttgttctaaaaatcactgctgtctcaaatggaagggctccaccacaaatgtgcaacccccagctgcacagaaagctgtcatgattatgactcaaggaatgaacacccaaaggaacataacatgggagaaggcttttacagtcttggtcaaataattatctgtcacataatttatttagacacaaaagcagacaaaatacccaaaagaacaactgtgggaagccatcatcactgaaaatcgttttgcccagaatctcgtagtcctttctaatcagagaacactaccatagaaactttctacttgagctcaaaggacaaacatggaggagatggctgaccagggcatcagtcactgcacctgtgtcatcagccccatccccagactctggtttagagcctgacactgagataatggaagtcgatcctgctgttcattccagtagatacaaggcggacactgccttctggaggcaaagccaagagggctgtactcttgttcagattttcccaagtgtgccttgttagccactcctctcataacccactttttgtcttttcatagaaggccttttgtttgagacaatggaaagacaccagcccaagataaatcaattgaacacttactggaatgtttgaaaactgcctggaggttgggcatagtttctcaatactttcttctccctggtgtggcatttgaactacttcatcatctgctttgtgtttccagtttgggagaacagagtaagcagggctgggaaaatgcagtatattccttaataattgtctagactgtgatgggattgcaaggctattcaaaggcaatggcagagggtgggtactaaacaatgcttattatgcttttctccctgaagcacttgtgatttatttgtttgcttgctcaatccctctacccctttcattcctggagattacagcaaaatcttgattataatgaagaaaggaagaatcaaatactgggcctgtcaaaatttgaccaactaatatcatctgagggaaagagtcatacgataggagatgagacattgcaggttctaatctcaaatggccctggagacctgagtgggctgttgcacaagtctgtgcccatgtcaccaggtctgggaaatatcatgaaatttggtgaaaagcctagagcagtgattgaagttccttgggaagatagttctttatatccctccggtaattcctcgagatggaaggcatcaagtctggtgacaggaatcattgttgattcatgttgcaactgtgacattccatggagctttccaagtcagcacattctggaaggcaccctctgtgtatcagtctcctcacttgggtttgtgtatttttgaccaggaatgtgagggctgcagttggtaacagccgtggtagaggaagaggagacaaggcaacagggaaaggactgcaaggcctgggactaaactgtgtttaaatctcaaggccgcccagggtgaattcactgggaagctgctgagccttaagcttcaaggtgtcttgctttcctgggtcccttccaagcgcttggatctgatttcaagaattctgtattggtacttattgtattgccttaaggcttcataaatcccacaaatgtcgttgatcctggcacttacatgtgaccttggacaagttcctctacttcactgagtttctgctttctcatctcaataacgggactaaggatccttcaccctgttaagaccactgctggggttaactcagataatgcagggaaagcacctaatacagtgcctggccaatacgaggacatcaattaatggtagttgttgctattgccttaccaaacgtggggtcctcctgttctctgttccttgccccatactcttggtcaatatattcctgaatatcccaaggtgcagtggagaatgggtgattttaagaagctccaaatttgtggccaactccctggagaggaaaatcaatagcctggagatttgcttcccttacttatttagtatacagccaaagccctgttccttatactcccttgggatgctccttggtgataagctgtgttgaaaggcacacccatagcaaaatagacacaacatgcctgtgtgctgaaacactaccatattatcggatagcaaatggcagtacccactatacgctctgccaattcttttcctcccacctgccaactcattcctctgaccctggctcaatctgccatccatagaatttaatgatctcttttgactgatggtacacaggtcatgaaactatttgaactttctgctctggtaggaacaagggggatgtgaaagaaactagagcaacaaaaagatgttaattctttgtgtttaattcctcgtaaatatttgatatcctcactccacataattactctgagtagttagatgggggtatccctccaactacagcaagtgagcctagggttggggcacccaagacgcaggatcactaacatcccagggacttgatagatacccagtgttttaactgctttcttcccctctccgcctctgctccccatacagatttattctgtaccacacacaaatgcactgggtaaaatatgtgatgaggaaacaaggggaatagttcataaatattctgagccatatgcaaacaatcttagatttatttttctcttttttaaggaggaaaaaaaatccacccattccatgatcacttccagattcattgaggttgatattacataagacccaatattgttttctcgtcgtagagaaataatgacttggaaacagcaatttgagctaagaaaataatatattcttaccagggcatggaggctgaatggggactggggagccaagactctaacccagcctccaacaagttcttgcaagaacagctcagccctggtttgctggcaaactcagtgcagcacaggtcctgatgagcataaggcaaagcagactcctggggctcaaaattcacatggagaggagcagatatcaaaggtggtctttgaaagaatgagaacagctctgtgggcccaggtggctgcacgctcaacttctcatatatggtttttctcttgtatgtgtgttgcagcaaaataaaaaccaggaacccacctgtgaccgttgtctgtagattggatgggtgtctgttcaactctccatggagaaggaggttgtggttattgggcactggcctgggccgagtaccctctgccctatcttgttccttttattgccctagtcccataccttagcaccagcaaggaaatacactcactgaattcccgcagtgagctagggatgtttatgcaactaccatttaaacacacaatgaggctattgagatggaaaatattattcatcgtcattcaacagatgaagaaactgagtcttagacttacccagggcacatacgcttatgcaagcacacacatagctggtccttaaaccattcaaactactcctgggacgtacaatggaaatgtgccttgctttgttttcaactgctatggtcttccttacaagctcctaacctctgggtggtggaaaaacaacaacaactttaatttcgtccattttggattataacctagtctgatgtaatcatctaaatagtccccctagagaattctgtctctttgcattgatatgctcagtttcccagagaacctgcccctccttgctctccttcctgagtcagtggcactgggaattggggactaggcccctgtgacctcacagcactggggagatggggtttctggaatctatgggtggaaggctttggaaagcgaatacaggttctgcatttcttctgtttgcttccttccagagtaaccatggggatgctgggtgggggttacaggtgggctgcttgcctccctccacaatctggaaggatacccaagcaaagcaccacacggagctcttaacatgctctagttccctgaccctcccccccaccacctctcctttcttcttcatccccaactcccctgtgctaggaagggtgggcttttcttttagttttcccaggtcaaatggcccaccaatcattgagcagaaagcctcgcggccttgctgcatagccagtacaactgtttctactctgtgagtcgaggcctccaggcagggtttttgatgggtaaaaattgagaaataaaagagtttagaacatcttagacaataggttgggtaaaagtctactgtcttgttgaaaatgctattttgaagatcaaaagctgaatattgaattcttttttctgtcttagagttccttttacagaaatcctaatctctctgaggtcaatgaatgcctagggcagattagaatcacgtactcagagtgacagagagaaaaaaatgttcaatcgattagctctattataatttaggtgcaaagcccaggatttaagcgcagggctattagattctaaaacataaactccttctactctgcaaggccacttctgggtgcaaggactgtcccatcactccttgggtattcacgtggcctgacaggtgctgcaaaatgttctcattcccctgacaaaagaggatggggttcccctcatgactcccccatgccttaccttccaactaatttggtaacatatttgtgttctgctaccagtgcttgatttcagatataattcttagtactttcagcgaccgtgatgaggtcaagaaggagttttctctgagtagaggggcaaccatgacccatcacatcacttttcaactctgcctgtactaggggccagtgctgtcacacgggctgtgtgacaatgaaacatctggtcaaaaagtgagaaatccatttggatttttcctaggaggaaagaaatatctagatattgagaaatacctggagcactgaatgaagtttttacttttcatcttctcatttgagatcatgttgatataaccaaagggtgcaaaaaaagtacagtggtggtttgagaaagaccatggcagacggagatgtctctggccatcacatatttttgaagagaaaatacaaagatggccacacttgttgacatttgatagtttaaaacgtgaatggtaacgtgatggaaacaaaaaataataataagaagaatatcaccacttactcatctgttggaagaagaagcctttctttccacaggcagctaggacaagaggaagagacactgagagagatcagatggactaggccaaagatccaggagcaagcgggatgtaggagccccagcagggcccaggaggattgggagggtgaggaaaagggcaggtgcaggccaagcaggcagaaatgtagatgctgctataacgagctcaattttgaggagaggcaaagatattctaaggggattttgaggatgttcagctctgtgatgggcagtgtaaccaatcccctcccccaccagaaaactttacataaagatctgcattcatctttcaggttttagaaatgagtcatgtagcttttttctcagttgccaaagtccttaaagaaagagaacagtagcccagttacagttaggttatatgagtatgaatgaccacacaaaggcaaaattataaagcaggtggaaactggggttttctcatccgcagtgacctttctaggactcatggcaggtaagggggggctgattttcaggtccctttgtcttttaaataatgtctacaccagattcttagaccacatgaagtcagaaatggcagcaaggttttagaagatgggaaggggactttctatcaggtctgatgggacgctctctgctgtgcctgggccctctggctatgtttgcatgtcactggtttcatcaaggaagaaacagagaatctgggtcgagtatgtcggggagccatggcttctgataacaaacacagtagcagagcagcacattcactctgccataagagatttgggtttgaatcctcagttatgcttgttcacaggttcacatcatctagtgtctggtgcagagtgagacttgattaaagttaactgctattattattattacagctatagaacttgggtttatgagaggatgaaggggaagaagacaccgagagaaagatgagagaagagatagctcaaggcagaaattcagtgtctgaagtgaagtttatctgaacatcctagcatgttccaggtccaaggagaatcctggagagcttgcaggatgaagcttgctcttgactttcctaacatgttagggatctaaagttgcctggaagcatctctttgggtttggctttgctctctccaggccacatgggtgtgtcacattttcttagtttgacagtttagagagttcatgtccacctttggcactgaaccaagaacactggacttggcctcatagccagagaggaggatgttgtcaaattggccctgggtgtgaacaacccaggggctcacatgggggaggcaattcccaggcctccgtttctaggcactgctaaaaacaggaaaggcagaaagacaaacagcggtttatgagaaagcaaaatgcaatggcaacttcaacagattccccactgttccctcgtgtggcgtcagctgggctacagagagtgtgcagcacgtggtgccatgggtattatttgtttgttctagaaagaatttcagcctcagaggggaggatgaattaaatgacaagctcctatagttctttccagtaagaagccagtaaatgattctttatttgaaagatagcgtttaagtcttacaattatggtgggttgggatataggacactgttggttgcccaccctcctctgtggtggggagaatggggtgttttctgatgtatttccaaggaattcagaaactttcttaaggaagacacagattctccacatagctgcttccccaagctctataggggattcttataaagaagcatctttttatttaatacagctccacaaatcacccttatatttggcgtatgttcagaagtattagtacaacaacaaaatgcatattttttttaaaggcaagagactttggccagtatttggctatgtttaaaacaccagcatggtaaacatttaggacaactttagcatgcctttagtataatattttcttaaagtatgaagggaggtagggactccagatccaaataattttctaaacctcttaaaagccacagtagatttgaagagaaagattatcacttaggtcttcgaattaagtttccttttgtgtactcatctgtagcatgtaagctgcctgaatgtttatttatcaacaggagaagggaggaagagagagagagagaaagagagagagatagagagagagagagagagagagactgactgaatgtgggaggaagctgcagagctagcgagctcaggagtgatcaggggagaagttctggttagggaacccggcccagactttagccatggggcagtggcgacaccttctggcttatccctgagcaaacaaacaaacaaacaaaaaactccccaaaaacctattgtgtattttccacagagaacatgtacgtgtgttttctattagactttccagaaactcataaatgattgtagaacccatcgtgctaatagaaagtacggcataaatgctgacggaagctattaatgctgattgtagtttatgtggccaaatgaatcaggctgaaatctgtgagtttttttatggttactttataacaggttatttttaagtatcaggccatagattaggtttaatgcggatgctcacacacttagaatgagctggttaagagagattctaactttatcagtcatccgttccagcgtttagacctagagatttttctcaattctccctcccccaaaacacttaggctgaagtacattcaccacattttgtcttgtttcatcctcaaatagccacatcttttacataagagccattcacaaacttaaaaactgcctctgtgccactgcaatgctagactgaaataattactggatttggtgattctgtgaatatcctacaaattctcttccagttgcccattcttttatttgttaaacaggcatctattcggtgcccactgtgggccaactttgtgcccctttccccacatggattgctgggtgaggaccctgatggggaaggtgggaagtgttgagtatatttaaggaaatacacatggtagtcattcattgagtattcatcggatcgtgaactgatttgatcaccatttcctaaatgacacactcttgtttaattcagcactacatacatattaaatagtggattatattaaatgttaatatacgcaagtcaagagcacagatcatgggaccagctgcctgggctggggtcctgaccctgacacatactagcttgggcaggttgcttaaccggtgcttgtttccttctctgcaaagtggagatcataacatggcataccttagagggttgctgggagcaataattgagtcatcacctgcagagggcttagtacagtgcccggcatgctgtaagcagttgttatgtacaatgtgtatgtgcaacgcatgatgatgctgatgtatgagaaacaaagcatacaaaaaaagcaacaaaaaattcttagagctgcaagaaaaaagtggctcttgcctctggctctgctcagtaaacatcgtgcttgactcatcctctgccctgaaatgctgacatgaacagggatattcagctgttcctttcattctgactctacagccagaaccacagtcccccagccgaaagccttcatcataacagatgtgaaatggggcaaccttaaaggttgggggtgactgatacttacacagaattccccagatatgctacaagtacacctggacctccctcccccttgctcagagcagttccctggataccctaatgtgccccagcaaaaattacagtttgtggggagaagctacccattggatgtttgagttgcacagcttttactacatgagtcttgcatctcctaaagtttgaagtgtgtagcaaattaaatgtgcaattttatacttctgtttcctgaaatctagtagggggtaaatgactcagatttttccagcaccaaaggagaatttaaaatagtgtgtcctttttggcaatggctaggacaggtattttcaccagagagagaaaaaatatcaccttaacttgaaagtgaatatataagaattgaatatacaagaattcagtctccttttatttgttactagtagaagacagagcccatatatatatatattttcagggtagcaatgtgccctatcaaaaatactcatcttcctagattcccagaatttcagctacagaaggccaaataaccaagttctggctaaagagatatcggtagaaattaatcaatgggcttctgggaaagataagatagatgcggctggcattgtctggaatgcggatgtgatgtttgggggtggagcaaccatcctgtgaaacaagaatgaaagtcacacacgaaagatggagaattaggagctctaagcagcagctcaattctcgacttctttcagcaactacatttgcctggaactctctactctctggacttcttgtcatgtgagaaaagcaaattcctcttaagaagtaaacatttatcaagagtgcttagaacagggcatggttcatagtaaaatgctatataggttttgctaataaaatacatgtttgctttagccactgtagtcaggcttctattacaaacagccaaacacaacatttgccaatatacataggtattgccaacatgccaacatgtcattattccgctttttttttttttttttgagatagagtctcgctctgtcacccaggctggaatgcaatggtgcgatctcagctcactgcaaactccatctccctggctcaagcaattcttctgcctcagcctcccaagtagctgggactacaggcgcgtgccaccacgcctggctaatttttgtatttttagtagagactgggtttcaccatattggccaggctggtcttgaactcctgacctcgtgatccgcctgccctggcctcccaaagtgctgagattacaggcatgagccgtcgcgctcagcctcattatttcacttttattctagcaccttgcacagcgtatggtactgaataagtatttgttgaaagaataagccgttcagtggggtttgaggaaagatgaaggaccctaaaatcatgtgactctatttatatacttatgtaataagctttaactctgtagaggaacaacagttccctttctttgtataatagtagcccttggtcttttgaggatagatgaagggattcaattagtttggcctgagataccctcccacagagtcccagccactttgttatcagagccaagagagaagcataggttagcatcaacctctctgccaaacgactcaggtaggactgaggcagtttcagacctgggcaaaatgttgagtaaaactcatcttagggtccccacaatggaaacagaacatggataactatcattgcaaacatcagtgggcatgagaccatcagagttagagctgagtgcaggaggtctgagaaatcacgtggctcaaccctcccctccccagaatgttctggaagggaagaggttctagacactagcacagagaaacatatatacacacacacacatacacacacacacacacatatatacatacatatacatatatatatatatattttattttttttattttttttgaaatggagtctcgctctgtcacccaggctggagtgcagtggtgtgatctcggctcactgcaagctccacctcctgggttcatggcattctcctgcctcagcctcccgagtagctgggactacaggcacccgccaccacacccggctaaattttttttttttttgtatttttagtagagatggggtttcaccatattggccaggctggtcttgaactcctgaccttgtgatccgcccccctcggcttcccaaagtgctgggattataggcatgagccaccgcgcccggccagagaaacgtattttatttaccttgatccagatcattaaatgctttgtccaccaggggtcttagaaaaataatttgacctctggctgctagctgaaaaaagtctagaatttagccttctgtgttttctcttttgactcttggtgaagtatcacttttaacaccaaatagaatttcccttgaatgtggttataaaaataatggtgaaaagaaaaatcccacttcagcgaagcccgccagcacactggccatcctagtgaggagagctgctcaggttcttgcattcttttattgattggttctaagtgagattattcaccatgaagcttgatatcatataacagaggctacaaaagcattgtatgttctcacgtcaaagacaatgctagtcacagaacatcataggatttaaatggggactgggaagttttaaataaatacagtcagagcataggggagtctgcaacatggggacagatttaaaaggtgaggttccacagcggggacaggaagtggctggaggacgtgcccgtggctctgatgaggccccgtcatcatctcccaagcaaaggcatagacaaggtagaggtgtgttgaagtgtttgtatacttttttttctctcatttaacaaatattgatggaccatctgccctgggtcagatgctgagctggggtctggggtgacaatgatgaaggaggcacacccagcatgcttcctcacagagacagctgctcagaaccctgtttctcacagcacagccctggaccaacagtgtccgaatcgcctgggagctctcaggccttgccccagatccactacctcaatatctgcttcgtaacaagaccctgtgggaaaccaggatatgccacccccaaaataggaaggattgttgagatgaagacaattcagaagaaacagaggcagtaaagctctctgccctccctctatttgtctaaaagcaggacgtagatttacaaagacaaaacgtatcttgcctccccccttctaccagggagaaccactgaaaacaacttaagacgcttatgctcctggagatggccctgcaggaatctacattgaacaagctttgctaactggcctttatctgccattcatttgctatcccccgaagttgctgcccctagagactcaaagtgttttttcccttgtcacatctctaaaagtttactgtcctttgatgaggatgctgtgaaactagaattcaaagccatctctttgagaactcctcattatagaaaatatacatgttaataaacttctgcttgtttttctcttgttaatctgtcttttgttacaggggtcccttccaactaagaacctatgggggttattcttcctctaaaacccccacgggattcaaatgtattcgcaaggtagaaaatggtctggctaacaagaggaatgaaaagaagtgctgctttatgcttaagccttaagtctgtgcctgtcttaactcatgaggctactccggctcagcctggaaacaagcttgagatggggtggagtgccttcctgcaagacggcgctggagcaggatttgaaagaaagcctggggttttaaagccaaagttccatgtagcaactttttcccaacaaattaccctctctaaactgctgataaagtcagaataccagactagatttaatccctggttttagttcttatgtctttgcaacactagttggtagcaaaagatgtttaaaagctgagaaatgctgaagcttttgctagaaggttcagtgcaccacctggatttcacatcttgtcattttcagccccagctctaccaaaaatgagggaatctgttctacaggttaacttatccagagatattctcccctaaaggtcagcagaaacttggaaaaagtttcctcaaagctacgtcctaaccacagacaaggggttatgaatgtagtaattgtataaaccaactgtgatactttcaacctacacacacacaatgaaatgtagacacacacacccatggacacactattgtacttctgtggtctgcatatcctgtgcttagtgggatattgtgtcccatcatgaatatattgtgtcccatcatgaatataattttgcatgtaagcactttcttttagattaattgaaatgagcctgtctaaggaggtatgtgatggcctttgccagtacataagaacatcagaacacacacgaagtgcataagtgtgtgtgtgtgtgtgtgtgtgtgtgtagagagagagagattgagaaacgtatttggttcctatgtgtagactgcacaaagacaagaggtgttggttgcataggatgaggtaacggtaggaagaggtgaaagaacatttaactcatgtgcaaatcagttatttaacgttcctttattccccaggtcttgatctgcatccaggccaggccaggagaactcattctggtcagacagcgggaaattccaccacatggaatggtgttggtggtctccgctctactccagtccaggagcccacacagcaaaattccactaatgaatgcgcccacccacgcagggcccagctctccccacccccttctccccatgcctgccccattcaacaggccacgccaccaccaaccgccttccttacaactgcccaaggattcgtttcaggagcaagatttgttaaattataaattggaagcatccacctcaataatgaaccaaatcaaagaccctctggaggaatccctcaggcagctcatgggagggaccagaggaagcatttgcccactcctctccctcctgccctcagccccaaggaccctccatgagggaggagacgaggacatgcaagtgcagagcccaccagacctccgaggtgggtcccaccgagcctaggttatttgtttttccttacaagaatgctagtcaaagcaaaactttaacccaacaaaccaacaaacaaaatacccctagttggctatttgcacacaggggttgccaaggaaggcagcctgaagggtccctttgtgaccagaggcgtttttgaaaggagacagcaatggctgctttatgaggaagtggtgagacggtcacatgttatccgcattgctgtggaggtcggcctgaccacccaggagccttcaccaagatggcctgataacagcccaccgtggggctcccaggcctctgcagcggtcttcctgggacccaactgtcctccaaaagaactgcttccaacagagtagacatggagccccacggccacctaagtgactctgtttctgagcatgctacagggtaattaggtttcacattcctgctgctttttacacacggccttagctttctcatcaggcctgtggcagagcacaaggcagaatgagaaggggggtgccgcatccatcccctggatggccaggccctccagacagggccactgtgacacgggggctgggggctgggagggaggaaggggagaaggcatgaagcgccttatgattgaagtggcttggaataataaatatacacactcttttttaaacgtggctcaccacatcctgggaatctggaaaaaatgccccacttcactgtccctcaccctcctccccacctaccccccagcagcagtggctttcatgacgcctgggggaaagcacagggcctttgataataaggggcttgttagttctaggctaacagccctcccaggccgctctgaatcctttcaagcacttttttattttaggtcaaggaagttcgtaaatgtaaagactcgagattgtagaaggagaagaggaaagggagaaagaagcatttgggggtagttgtcattgggaggggcagccagggacctcctatggtagatccgtcaggcctggtggacatgcccttcccttggtgtgggggacagataatggaaggtggctttgagccttgaagaagacctagccttgtttgaaccgtctaagctttggcttagataaaactgaatctttgtataggaagaccctttcgaatccacaggccttgaataaatcacatcagctggctctggcgacgattcctctgcctgccagaagagggcagcacatgcttcctcattacagggaaagctgggctgcccagtccaaagggtggacactaggtatggaggcggggggagcactgtgaaattaatagcagcagcagcaacagcagcagcaatagctatcacatattggtgcctactgtgtgccaggaactgtcctaagtgatttatatgcattaattcatctaattaacatgacaaatcttcaagagagggtgctattacaatctccatattaccgttgaggaggctgaggcatactgaaattaacagaacttgctattgtagccacggactgcctaagattgaggtcagcaaattacagtccaaggactaaatccagttcactgcctactttcatgctgccctcaagctaagtattgttttgtgttttacatttttgcatggttggaaaaaagtcaaaagaagaataatatttcatgaagtgagaatgatgtgaaattcaaatttcagtgtccacgaatgatgttttattggaacacagccctatttatttgtttacatattatctgtggctgctttatgattcctgcagcagaattgagcagagtctggtagaggctatgtagcttgcaaagcctaaactatttactatctgaccctatatagagaaagtttgccaagccctgacttatgaggaagagctacctgtttccaggcaagagggacagagaacagagttgctatttactggaaatggagctagtatcgctatcccagggcaatttagaagcaatgttgaacttgattcactttttttccaacagggcagctcaaggtcaagcaaaaggagggtctgacatgtcactgaatagcctcaaggaagtaataaaaggttagatctggaaaggactgtgaaagtccactattatgtctcaagtctaaggtgcacatttttttcactctttaacatctgtgaaatcaggcaatgtcttacaatcaaaatatgagaggttaagtgaaaacactttgtttaagtgatagcattttgttgttgtttcttagaggtttgtttgtttgtttgtttttgagatggaatcttgctctgtcacccaggctaaagtgcagtggcatgatcttggctcactgcgacctctgcctcccgggtttaagtggttctcctgcctcagcctcccaactagctggaattacaggtgtgcgccaccatgctcggctaatttttttgtagttttagtagagactgggttttgccatttggccaggctgatctcaaactcctgacctcaagtgatctgcccacctcggcctcccaaagtgctgggattataggtgtgtgccactgtgcccagccagtatttaaaataatagtgtcgtacaatcaatgacaccttagattaggcagttcctgcctccaaagatccagcctctttttggtcctttctgttgatgggatactcacttcttttgctggcagtccattctacagatttaattttaaagtttcttttcttttttctttttagacggagtctcattctgtcgccaggctggagtgcagtggcaccatctcggttcactgcaacctacaactccctggttcaagtaattctcctgcctcaacctctcaagtagatgggatataggcacatgcccccacgaccagctaatttttgtatttttagtagagacggggtttcaccatgttggccaggacggtctcaaactcgtgacctcgtgatcggcctgccttggcctcccaaagtgctgggattacaggcgtgagccaccatgcccggcctaattgtaaactttctaatgttgagctgaagtgtgtaagcctaaattttctatacatcaaatgaggatgatcttgcttaatacgtttactttaagagtcttaagatcttattaaaagggagcgaagggaaggaagcactgtgacccccggggtagggaggaccagagccggctgcaggaatcagtctgtcggtgtggtcacaccaggcagtctgcaagatgggaggacagggatgagttgttggggacacaaaccatgaaaacctggaaggaaaagaaagaccgccagtgatacagatgagttctttttctagcagcatcagccaggagcatgacccactgcaggtggcacctcttagaaggagaagacaggagcaatttgaagattcgggcctgaatggaacaagaagacaaggaaagagcgaggaatgcacctgtggctggcttgcccctgctgccttatatgagggctctaggagatgaggaagggaaatgagagaggcaggatgacagtcattgatattgtgttaataagaaccacaatgtcctccttcaatcacgttcccattcagtgggaatgatcatccaaattctgagataaactcactgaggttcctagaataacccgagagtcttcttccattctatgtggcagggacaatcaatttttccagaataagcccagggagcttccaggttccagaaagaggagcctctgatgtgagccttagggaggtggaaaccttggcctttatttggaaacagaaccaagactgctcagggacctgtgtggctaatggccacttttttgttccagcaacaaattgggaaccaggaggtggtgggaactagggtacactccctcgccctctggtaaccacgtttgagcttggattggagagaaaggagaagcagagggcttagccctaaccaggtgcttttcatctggggacatgtgtcctggatttcctgggacagtaccaatttcttataatttgattattttcaatgaaggcaatttgttaggcatctgattttcagtttggaaaacatggccactgcagttacaactgatgaagggcaatgcaatctgagcacatgcccagcacgtcacagataccaaggaaggtttttagggctttctttcggaagttagaagcaccttattaggacaagtattttaggaagagtatgttaggacatctcagagtcttccataaaaagagaactaggtgcagccttgcgagtgaaaggggtacatctttgcacatctagtgcaggagcccattcatcttgatgaaaatagataagcccagacaggctgttctgtgtcccatgtgctgggtggacagagaggggcagggaggttggcgacacacgcctgaggctgcagggaggtctcctgagtcttccagagaagatggagagaaaggaagaaagtgagtttcaggtgaagagagaacacagggattgtgagatcgggaggagcacagctcacaggtgggggaagatggagaggagtcagagcagcaggaagtcagcagggcctggagtctacagcagcctgaaagagaagtcacaggaggggagagccaaagaaaatggaaaccacagctcctccgtgcctgcggctcacagcaggaatatttgttattcttctgggaggctggtttgtttttatcttctaggaggaccgagctgcagctgaccaggggccctgttttgctttgtctgctcacaagtttagagccaaatttgtggtctaccttctgtgtggcgcacgaaggccccggggctgccctgactgttttagctcacccagggctccatttgatggttgtctccttgtttttctttctcacctcctcttggcctttgttggtttgccgtgctttatgcatccctgggagtagctataaagcctttctggaacaagtggagtataaattttaaaatagaaagaaggccccccaagacagaggaatacagaggtggaaataagagagaaaagtggacttgaagggggaagaaaagagggaattcaaaggaagccttgaaagactaaaaccatccagattgggcaaaacaccacttagtgcaggtcgcctgggaggcctgagagagcttaagccccaagactgcatgtgatacagatgagatactattgcccctggggcttttcagacctctcactaggggaaagggagtcctgtggaagtgggctgcgcaaaaggaggttggatggaaggtggtcagcgtgaatagagcaggagaaatactgaatttttgtcttaggctacaggcataggcatgcctacttcctctccagctaaaaagaaaaggggcaaaagcacatgagaatatgacactggcaccaaaaacaaggatggtaattcttggtaggacattaactgtatctgagggaaacatgatagacctggaagaaattttaaaaaggggtaggagacttttcaaattagttaatcaaaatagagcattcaagatgcacattagatccatttgttaattacctgccatatgcgatggggacagaacatgaaataaatcatgtgtattgctaggattgaagcataaggaaagagagattgtggaaaataaagtgaaatatagcactttctgcctagattatgataagtaactaaaatgaatttcttgaaaaccaagagatttgcagggatttttagagtctgttcaaatggcagattgagggtaagaaatgcaaaatgtaagacagatattcagagggagaagtccacatcctcttaggaatgacagagagtgggggacatgttaaagtaggtgtcaaagaaacccctttagggaagagacaaacccaaggagccaaaggggtgttccagtggcaggcggggaggggtgtttcacagcgacgcttgctagaggtggaggcactggcttgcagaaggtggaggcctgggcccttgctgaactccaccatgtgccaggcaggctgggtagagagcatgattaagggggaggacagacctaactgcttgctaattacagggatgctgcaggatgtgccaaaggggcatggatgacactgtgccctccctcaagccttctacttcagcactctatgaacctccaggtctaaacccagggcataacttctccctgcaagattgaaaaagtgaatgtggggctcagaggaggaacccctccagccaaatctaaatgcagtgctgctttctcccatctcaaagatgctctttcgcaggaccacgagcactcttcccatgtgggttcctgatccagttccctatcatcacccactggtcctcccctttctaagggagcagggtttgtgcttcctccatcagactgagctctctctggttgtgtagaatctgagtaatgggtggattccacatgagaaaagcagacagaaaaggatatccaagaacactttcagggagctgcacatagcaggcaaaagtctcccaggaccttctctgcagcattttataacacagatcactcttttaaaacaacaacaacaacaataaagcttgctttcccatctttatgccctccccactacccccgatttcctccatcctccctggctagtccttctttctcttcctccttgactcctctccctctgtcatcccatctatgtgattgatccttgggcatcgtcttaatcatctaaagatgtataacccctcaaactgcatttttataccagaactctctgctaaggtacaattgtctacccgagataactgctcagaacaacggctgactttttttttttttttttttttttttgagatggagtttcactcttgttgcccatgctggagtgcaatgacgtgatctcggctcactgcaacctccgcctcccgggttcaagtgattctcctgcctcggcctcctgagtagctgggattacaggtgcttgtcaccataccctgctaatttttgtatttttagtagagatggggttttgtcatgttggtcaggctggtctcgaactcccaacctccggtcatctgcctgccttggcctcccaaagtgctgggattacaggggtcagacaccatgcctggccccagcagctgactttgaacgtggtagtgggcattattccaagcacacttatgaggtatacacagttattacccccatttcacagatgaggaaactgaggcattacagagttgaagtaacctgtgccatgttacaaggacaagaggcaaagctggtgtctgaactctgaactctaaagtagttggctttagagtctgcaagttgagccatacacagtcacctgcctctctgcataggaaacacagcatgtttagaaacaccgtccttatccttctccccaaaaccaggcgtgtgggtgagagatcttagagcacaagaaaacgaagcaacttccccaagtagcacctgacttaatgtgggatcttgccaccgagtcatgagaaaatccagtctacatttaagtgaagtgaagagcaggttggaaagagtgagaggagggggcatggaggcagtatctggttactgcagaccaaggggacctggatctagaaattacagaggaggggtgagtacagtgataggcctaaacacggagcacagaatcgtccctcagggaacaaaaaaaaatgcaaggctgctgaggtatgagagttgggccaggccactgacgctccttgatgacactttggagaggaggaccatgcaccaacaaagtttaaaaagtagaaaatagactgaatgggtgggagatttggaagagctaactgagggggaagcaagagctgaagcagcagtttctgatgtcattattcatcttagtcccatttttgtgctaatagcaataatcagaataatcaaatttaacagttacgaggccagacactgcgctaagggttttacatgcgctgagttataaaatagatgaacctgcattacaaaccttggtgatattattaattaccttattgccagataaagaaactgaatgtaaagtccattttacagatgcagagccagaggctcagaaagaataagcctcttgggtaaagttgtgcagctagaagtgctgggattcaaacccaggccgggaattgcacatgtacttgttttacagctccctgtagattgttagttcatggagggcaatgactttgtctcgttgccttggcaactccagaacctagcacagtacctggcacataagcagtgccctttaaatattagctcggacttgtagtcactttatataacttgtggttttttgaatgaatcagtgaatgactgaatgtacaaactaatggatgattctctccattactccagtactgctgggatggctcccacggatggggtctcggttgtggtagctggggacttacaaggctttggggaacaacagggaaattttacttggtggttcctgtagccaccacaggagtggagtggagaggtgacccaccatggagaaccatgtaacagtgttggcttttctcatgctttcattttgagagggcagaaaaggatcatgacctgggccagtgtgtgtatgggggctggggcattagtgaccaggtagaggggagggagggctctgctcaagagaaagtaaatgaaaatacaagagaaaccctctaaagaaagaaagttggagaactaggtgcagagctgaagatccagagggaaaaaaatggcaaagtaatgtagggcggcatgtggaaggaggcctgggcctgaatgctgatgctcttggggagaggccacagccatggagctcacacagagcagaaaggggatggaccatctcccgggtcaggggctgtggggctctgggaccgtaacacaggagccatgctgctctctacaggagggcaagccttacaggagccttcacctctggcttgctaagcctaagaattttggacccagttgaccacaactcgggggtattgggtgggaggaaggacaagtaaagaggaagggaggggtgtgggcaagttatagttccagggaaggaatgtgtggtgtcttgttaaacagaaggtggaatagcacatctggggacaggctctttgggaaagcagcaatgttggagctttgaaatgtgcaaatgagttaggggaagcaggagtcacaagggcaagtctcattacagaagaaaacagggtgaaacagaagaaggggaaacaatgaaaattggagagtactgagtttataagaaatggatatgcggcatttggtggaaactggctttggacttgggaataggagaactgtaaatatggataatatgtaaacaccatttataattttaaaaatctggagggctcaaatgagataatctttctgagggcactttgacaagtatgaaagaagatatttgtggctaagaggaaaggatactgggtgtggagtctgaaaacgagggttcgagagccagctctgccttgggggtagacaagtcatgggtcttctcgtttggttctctgtcctcagccgggaaagcagcaatgactcttctttcccacaatggctctgaggggccatattcatttcctaggactgttacaacaaagtaccacaagctgggtggcttaacacaacagagacttttccccttacagttccaatatcaaggtattagtaggtgtccttccttgcctcttccagcttccggaaagctaagagttccctggcttgtgacagcatcaccccagtctctgactgtcttcacatggccttctctcctctacatgtctgtgtcctctcctctcctcttttttttttttttttttttttgagttggagtgtcgctctgttgcccaggcaacagtgtgatctcggctcattgcaaccttcgcctcctgggttcaagtcattctcctgcctcagcctcccaagaagctgggactacaggcatgtgccatcacatctggctaatttttgtatttttagtggagacgggggtctcagactcctgacctcaggtgatccacccaccttggcctcctacagtgctgggatgtagtcaagagccaccacacctggcccctctcctattcttataagaacaacagtcattggatttagggactacactaaatgcaagatgatctcatcgccaaatccttaactaattacagctgcaaagaccctatttccaaatgaggtcacgttctgagatcccaggtggacatacatttaaaaaaatttttttagagacaggaccttgctctttcacccaggttggagtacagtggcataatcatagctcactgcagcttcgacctcccaggttcaagcaatcctcttgtcatggcttcctgaatagctgggactacaggcatacatcaccttgctcagctaattaaaaacaagttttttttttttttgtaaagacagggtcttactatgttgcccaggctagacatgaattctggggggacactactcaacacactatagggttcaagcagcaatgaagcaagagcaccaagtagattgaaagtactttccacatgcttcttcttatttcccagaagccactctctttctagtttcttgacacacacctctaatggatgtcattgcccacaagataaaaacccaagccctccaagctggcactgtgggcttcagtcactttttccagtctctgtccctgactttttctcaacttccccgcatcttctgctcaatgatctcagccaactgcttccttcttaatctttatgacccagttgaaactcccagaaaaggagtctcatgcatttacccccatggtaaatgcttctggttctgaataccttcgacagaaattattttgttcttttacctgcagttaatcagctctccagaccctcttggatcaaactgacttgaagcctgtccttctgcatctgccaggcattgaagactgaggaagtgtttgtttcttctttggacctccagaaccaagttttgcacttgtcacaatctgggtcctgagtagcttcctgaattatttacttcccgatacaccaactctgttcctgccatgatttcgtctcttttaccatgcatagctgcatatgctggtcgccttgatccaaagagatgctattctccttggagcttctggggcatctagcatctattcccttgttttggtccattgtgcatcagtcacttgttcattcacaaagattcatggagcacttaagttgcttggctttgtgctggactccagtcatccagcctgtgaggctgtcctgtcatcccattctgagggcaagggaatggctgccattgcccataggataaaaatccaagccccccaggttggcactgcagtggctagcctgttcctcctgggcctaacaccgttcttcaagtgttatacctgcttaattggacggttccattcaaatggctttaggtaattcttaaagggcaatgccaaatgaaggactgaaagtgctgtgagcataactgggggggactcagctccctttcagaaggccccgcaagagaaccaagtcctgaattctgtagccaatgtcagaaatgaagggcctgatgtaggatgggccaggctttgaggagtggctttccagggcccactgtcctgcagaaggggagaacacagcccaggtctgccttccacatttgccacagtagtgactgtgctgcctctcccttggcctctggaaaaatccctggagaaaccttgtagggaccagaaggaagcgggaatatgttgctctaatgtgatcacaggcagggttgggaacttgggacaaatgggcagtgaggaccgttccgtgcagtgcactatgctgtgcaataaggcaggctcagatgacaaagagcatccctctctccagcttggcagtaaagccccaagcctttcctcctgcaccagctaggcagcagcatccaccacctcctcccctgtgtcaagggggacaagatggtggtggcggggggtgggggcaaataataagcagtattggttccagatgcttctctggcccaagtatttgacatgcctatgggcaaattgaagatgccttgggcagcagatagaccactgccaagggttcttggtggaagggagtcactcaccagcattgttctgctgcttggtatttttgatgtaggcagaaaacttggaaaagatgtcgatgcccgctgtgttggattcccggtgttttgcagccagtttggggtacctggaatggaggatgcagtgttctgtgaatcagtagacttggagctcctttaagggtgagcctatccctatcatgataagcaatacttccctttccagctgcatctacaaaatgttttgggggtctttatcctcatactatagggagggtgggcattctcagccctagggcatccatagaagaaaccagaggccagtgaggtgctgagatctgcctagggtgacacagtctgctaggcaaagaaccagaatgccattcaggggtctcaggatgtgtccttttcttgggaccaccaataaggatgtgccagtgggatggcgcaatcaaagttccctctgagcttgcctctctatctggtagggttctcaacacttcccttacccgctaaaataaccatctactgccagtcctgtgattataatcctagctacacagagctaattctgggagcaaggagaagccaggtatgttagcattaaaccatttctccaaaggaagaatacccacggtcctcttctgaaatgcccttacatgcttattatttgtgtgcagtaataacatgcagaaactaccaagctccaaaaaaggacatgtgttttcaattgttttattttattttatttggagatacatttgcaatgatccagcccccctctctctctctttcgtagagtctttcattttgaagccacaataatacaagaggcaggctggagttagaacgattggccttgagactgaaggaggtaaacttgctcatgtgggaacccagggcttggactcattagccccatcaaaatgaaaaaaatcaactcaaataaatattatttcataagcattttatgggtatggccaggtagtggtgggaagagatgggagacagtcgccaggctatcattattttcaatgaatgtgcacctctgtgatctctgggtgaatcgtttttgactgtgggctggtgggttgccttacgtttaaaaagcaaaatcctttttgtttgttttgatgtttttgatagttcgaaccaaacaagactttaaaaaatatttgttgttctttaatgcttttttgttactcaactggcccatgagctaggattccttttggggccccttttggggccatgttaggtggctgtgtaatttcagagatactgccattggaagagtccagctctctgctgtgaggcagataaggaaggcattattgtcctccttttacatggaagggaactggatacctgagaagataaatgttgatggctaataaatggtggagggacgatgagaacctggtttcctggccctacagcagtgtccttccccctccactgcttctctggaaacagtgaaaggtaatttgcattgagcacctactgtgcagcaggcaggcactgttctattccctttacacgtattcaccatttactcctcagaacaactctattggtactattattagcctaatttcctacatgaggaaacggtggcatagagaggttaagcaatttgcctgaggtcacatggctgcctggcagagccaggatcccaacccaggcagtttcactgtggaagactaggttttaaattccacattgtgtggcttctcataaactccgctgttgattctcaaagccccagaaccttaaaggctgagctgcccaccttggaggagctgtctccatccatcaggagggggtgctttgcaccgatgctccacacacatgtcttcctgggtatactgagaatcaccacattcatctgctgtggctgggggcacacagcagggcttcctgcaagatactaggtaatctaccaagacacaggaattcagtgtcatctctttctattttggccttctcacatagaatccagcatgctattagaatcgatagacttaaattgctattaacaaatgccaagtgttctttgtttctccttgataatgtaaagacagaaaggcctagaaaatgcacctcagtggacagcttgtttgggtttcttgctttgttttgctgtatctcatcaattggtcagactttcagtcatctgatcatttcttcacaatcaggttgggccaaacagggatgtgtggtaccaaatccaagatgatgacagaggatcgtgtattcagggggctgtggtggtgtcatcctgtttcccaagcactaggactcgttgtgattttactgtgtagtgcagtgttccatttgagctttgttcttgtgggaagtgcgtctctaagatgttaatctcgcaactttcagtaactacactgggggaggatactatataggataagtgcattcattttacctccatatttatggcgtgttttaaatatgcaaataagcgggctacaaagtacattctgtttctctaaaaggctaaggaagagtgtttcactcacagaaacagctttgaaataacattggatgtgatctgatgataatcaaagagatgataattttttctaactcaggagtcagcaaactgtgacccatgacccctatttgtctgaggttctcaagctaacaatggttttcacatttttaaatgcttgaaaaaaatcaaaaggaggatactgttttgtgatacgtgaaaataatatgaaattcaaatttcagtgttcataagtaaaatattattgaaacagcaatgcccattcatttacatactagtttatggcttctttcacagtgtcactgtggaattgtgacagacactgaagggcccacaaagccaaaaatacatgactatctgaccttttacagataaagctgctaactcctgatctaactgatgaaaatttctctccacccggtttttaggatatcttatttcaaatgcatgcacttaactttcattctgggaagtaaaacagttggcttctcaccaaaaaaaaaaaaaaaaaaaaaaaaatttttcaaaagtagaaaatagtagcaaaaaaagagaaaaccattgcagatggtaagtgccctatctggtttagagtcccagctgacttctcactgactagccacagccaaccaagacactgaacaaaaggatacccaccatgcaattaaaccaatgtgcatgaaacacctactgaggactaggccctgagattggttttggggatagataccctggagaaaaagaaagacggtcctgatggaatggccttgctgatggcagcttaagtgttttccctcctttttctcacgagctgaaaagtggaaagacttcctctctctctcccttctccattgttcccacttccttacttcatcaacccctcacacgtgaaggacgttaatgcatctgacttttctaatccttgactgtgtgcttgtttgactcatgtctgctgtgtaagcaaaagatctctggaggtggaagaggcctggcttattcattaaaagatatcccctaggatctggggatttaagacctaaggtcaccaattgtctgtacaattgcacctgggagacagacccaaaacaggcactggccactctttctaactccttgagcttccatttaatgagctcttacttcatatcaggctctaggctcattagtattattttttacaatagccctataagatcaacagtatggttcttgttttaaagatgtgagaattaaagattctagagaattcaggtcatttgcctgtagcggagaatatgcatactcactaaatagccatgtaattctgtttcccagcttctctctcacctaagttgggatcacgtgtggattctgaccaatggcataggaaggaaagtaatgtcaccatgacattttttttgcaggcctggccctgcaaaacactttgggagatctttcttctctctctccctgaaggagccttggagggcatgtattccaaaaactacaggatggaagagggccaccctaccctctcagaatttgctcaagtgagaaataaacctgtgttctgttaagcaactggaattttatggccgctttgttactgcaacatagcacaacctagtggtatggatttgaacccgagtcactctgactccaaacctcctgcccccagctaccatgccatcctgtgggaggtctggaggctgtttctctacctcccagagggtcagaactttcttgttttttactgtggtgagttatcgctatacattttgtaaaataatgaattcaagttgtcttccaattctgtcagtgttctgaaccctgttgatacttaaatcattcttgctagatgactgactaaatgacatgctgtgtaaatagactgtatcagtttaccctcctgaatttttattacagcatctatgtgctaggattatttgagacaataaccagctctggaagagtactttgagaaactcatggaattgtggaacatgcaacaaaagacatcttggagactatgtagtttcaccccctcattttagagatgagaaggcaaggagggtctgagcgggagagaggcttgtccaaggtcatatgacaaacactcatagagaggtggccagaggcagggctcctgactctcagtgctgaatcctagaaactttggccacttcaggagatgaaaggcaagggccagaatgtctcaacagtaatcccagcattaatcacaacacttccttgtcgagtgttcactagatcaatctaaggagagggatggatgttagtctcatttagaaacaacttgagacttcctggattcctcattttgacaccaaatgctccctgggatcaaatgtgatttgaaaaaaatggttggagtgtttgtatgtggttttctcctttaaaaaataaagctaagggaaaaagcctcccataatgtgttggcttttggcagcttttacaaatagtggtatgatgagaaacacatggccgaccagcgcttggtgaatggttatgagggttttgctgccccctagagaaccagaaggccaggctgtcctgctccagaggcctgacaacctcccagccactccatctcccagcctgagtcgctggggaagctggtgaggctggtggtttgttctgggcagaccagcaggtctctatggggctgaggcactggcttggtgacatttactgggaggtaattgtggcacctgcctcagtctgatgggtgcaaaggcatctaaggtataatcctgggatgctctggaatacttgatggcctcacccttggcgcccccaccttggtaggcttctggagatatgcattttaacagcatcaagcgttctgctacctgagagtagtggattgttaggtcactaacatggcaggaatgcacttcataaaacctcctatacacaactgcagtccagagaaggacctggaccagcgggagcagagctcaggacagggaaggtaggtggagaggagggagtggagggagggtccacatccagccctgcccagctctatttggatcatggaaacttagaatctgatgaaatgatgacgaagtcagatgatgactcgcctctggaagaatgttcaaggacgcatggggcatacaattccagtgatctctgtccaccttgtggtcccaccgtggttgcagattggagacccctgagttagagaagcagcccaggaaaggcacagttgcactgggggtggtgtggtagtggtgagggaacctggctaaagggcatgtgaagaatcagagagcaagaagggctctgggagatatcctgtcacagagaagggaactgagtcctagagcagagaagagactggttcaagaggtgaagggactggctcaagaggtcacagcacatcactagcagactaggattgtaccccagcccctcacccctccatccactgcctggcaacagaccaaatgggcccctctgctcctcactgcttccactttccacttcctaatgatcatgacggaagcccccactcctgagtgccagtgttacttctaagagggaaaatgttaactgcgtcatgaactttcctctatgggtctcccaggcaaagtctaaactctagttattgaaaacagcattttttttcatgtgggatttcaaatcagtgctagcaatgaggttgagtcccggggagggggatggagtctgggctccctcagggcaattccagtgaagtggctggctggtgtcctcttcagagatgtgtgtgtgtatgtggggctgtcctattgatttaattaatgcacttatttagagtctatactcagctgcttccaatgggcttgaggtggctttttcactctcagtgtgcaaataagctgactgaatatggatgacaaagaatatttttaaggaagaatatatgattgtttaaggcttatttggagcatgactggcagttttaattttttaacagcaattcactagatgtgcaaccttgggtaagtgacttactctctccctgtcctgactgtgaaatgaggataatgatagtacctaggatgctagaaggatgaaatgaatcatattagctaagtgttgtgaatggtgcctgacacaaaatgaaggctataaaagtgttgatgaataaataaaactttaaaataaatgcaggatggtggtttttagtagtcaaatctcactaactttacttactcagtatgtcctgaacccttcctactcctctcccccgattttcctgccctgtcttggcttagcccttcattcgtcctgcctggacagtcaccaatggctccccagaattaattcctctatctccagcttcatggtcctctaggataccgacttccctcaacctctaaagtaggtcttaaaacggactccccacctcctgtgcttaatccctttcagaatatcccacaggactcactacaggataataccctacaggataaagttcatgcctcactctatatgtaatattatttttctagttttttcaaaaattgtgattgttttaatccttgataatagtattctttaatgaacaagtctagcttgggtaaattttagaagccatctgtcttctttttactgctcttttccatcagtagcaatgtgtcacccaacaagaacttatagctctacggtctatactctccctgaacctgtttgcagaagaggagctgctgcttttagttgatttttttcatctgtttaattgtggactcagaccagatttggtcaggtttaagaccctggatgttgttttaagtcactgggttaccctttcctgacttattttcattctgtcaggctttcggctctggttctgaaatgaaggaaactttgtcctcacttcaacgtcttccaagcaaagtgagctggagagaaggaacatactggggcgagggaggcctggtatcctagggctcctaaaatcactctgtgtaggtaggagtgactggctcttgttcataggccatatctactcttgagtggattttgtggagtggttttgagattggcagccctttgggggtcctaggctctctctttgaagaaagggtcctgttctctggactggtgaggttcctttggaaatgcatctgcccgaagttaacaccaggactttatagatccagcatgaacccttcccattcaacagccccagaaagaaacagatccttacttttcaggggtcaaggtctcctccaggaactcctcgatcttattgacgtctgtcttcacgtccccgttgaaggtcaggaagggcgggtgcgtgccgggggctaggttgtgcaggtcagctggctttctgtagagagagcaagattcaggtgttggcttacagcagggtgcttcctgttctgggaaacctaagattgattgtaacttagatgccctgtgctatccaacatgcctgtcaggtgaaacagatttatggtatgcagtatagggcaggggaggttggagaaagttctgaaagaatgtggtgtgacccaggaagtgtgtccagtggagtcagtgagagaggaacaagtcaagatgaaggagttgaaaaaatgaaagaattgaaaaaatggagagaatccaggtgactatctaagtcagatccaagctttaattacccaggggagaggtggggttttgcttttaaaagctctttcaccaatctgcctaacaaaaatgcgctacacataattccatactttaaaaattaatgaattagatcatacttttctcctaataaatatctccagatacaaaaaattgggagtttgggccatttgttcaagttagatgcttctattgtgtgtaacttatattttaatatctaataactaatgtctaacattggtcagccttttgtcacactcaacagaatactctttttgagttataaacagcccctgatatggtctttgggtagccaggaaaataaacaaactattagattgaaaacaaaactattaaatgaagatgttttcaaaagtcttcttattgctaagattattgctccacaaacaccaggtaggctattaccaaggattctgaaccaagaacctcctactggtgagtaagaagatacctgagagaaagccttacgattcaagctccatgagggaaaggacccagaaccatgcctggcatataggaggccctcagtagatacatatttttaatggctacatgaataaagcatgcatttttgattcagctacagtggctcatgcctgtaatcccaccactttgggagggtgaggtgggaggatcacttgagcccaggagttcgagaccagcctgggcaacatagcaagacccccatctttacaaaaaaaaaaaacaaacaaaaatttgctgggcatggaggcatgtgcttgcagtcccagctacttggaagactgaagcaggaagattgcttgagcccaggagttcgaggcagttgtgagccgttgatggcaccactgccctccagtctgggggacagagtgagactcggtctcaaaacaacaacagcaataaaaactcatacattttaaatttaaaaatgagtgattttagctgcaaaagtagaaatcaaatgttggtctcaaattggtaaaaacttcaatccagttatgaaggctttcggctttcagttaaatgtggggagaaccagtaggcaactccactgctacagtattcatgctccaccatagtctacctttcacagtattttaacttaattcaagcatctactgttctcaaaataagacttattttgagaacatttactagatttactagaaagaagttatttttctttaaattttaaaaattctgttcaacatacataaatcaaaaatctcctaggagtcagaaattgtgcctatttttaaaaattatggggttacttaaatgttatcttaagttaaaaacaatttattttctaagtaaatgcaacttctgctttgtgatgggattcaaatagatcacttgatttatgaaagttatttcttcttatagcaaactttgctgggcccagtaggatcttttaggtaacacatacatatatatgtaataggcagcaaatttgctccctaagaagacagaaagctctttggtgtgcctgttagtttctgggtcagacacttaaagaaatccaagataaccaaagcaacagtgcatttctcccccctgggaaagaggagacccaagagtcctaaattatcctgaaagaaaggcctagatgatggagaagtgggtgaaattctggaacgcagtcccaattgaatgaatgaacaattaattaactgaacaattaattgaacttcctgcacttagcccacagcagtgctaagtggcatttctggcgtgcactggggagcacactgactacctgcaggaaggccaagtgcagtggaaaggaaagtggccttgtgtttgacacggctaggtcctgttaatatccaggagtgtgcttctgtgtctgcgccagctggtcagaatgcaagagcaagaatggagcaaaatgagggggaagaaggtttggcagattggggaaaatgggaaaggggagggttacactaaaaatgtttagggaagaggagggaaaatggtggcgacttccaagacggtgctgggattcaccccaaatgctctctctgagaatgccacatttcttgtgggagtcgggagtggaaaacattaaacgcagaaactgtaaaaaaagtaaacagtgggagtagaggagtctgtaatgaaacaaattcctggcgtaatcagtttgggaggggaagagaagaatttcaattactgtgctactcccatgtccctccccaaacacacacactctccagctgcattctgaggcacttggaactcagacaactgagacggaaagtatttttaaaatctaatttacttagtccctttatttactttgtgcatgtccctcattttagacaatgaaaggacattctttatttgctcctgttttttagagctgacacaaggcagcaacgtgtgtgctctcagtcacctctctgtggcttacagatacaggaatgtgtggtggtggtgatggtggtggtggtgggttttttcctgggattctggagaattgtggccactggagtcagacgcccttgggaagtactgcctatggccaccgacgcttagctagagttgcagccctctgtctttgttgaccctgcttcagtatttatagttgagactatatcattagcattggatgacgtattgccaggtatgatttatgaattatgtaatgaggatcggtcttcttttccttactggattgccagctccatgaacccagtgataattctaagaataaccaacatgcaacgagttcttgctatgagtcaggtacaggaccaattgcaaatgttttacatggcctgcctcgataaattctcacaataatcctattgattaagaagacactgtctccattgtacagatgaggaaactgaggctctgaaaagttcaagattattcagtcactaaagtgtagtgccaggaaaataaatcagttttcttagaaattaatgtgtgtgttcatgggtagagggggcagtaagaaagtttccttatctgtaaaaatggagtggtgctacatgcctggtctacgtcaaaggggtgttggctggaccaggtgtgatcatgtgaaggaggaaccaaaccatctgaagcacgcgggcaggggtggttccctctcccactctcttctccagcaaacatacaagtcctctctcacacatggtaatccaaacacctccaattctgcactgaaggaagctgctttttcataagtctgctgctctctttagttatcacagacattaattgcatagtggatgcaagttcatttatttgacagatagtatttgaggacctgtgaaaaactagtttctatggaggatacaaacaaacttaaaacacgattccagtctgtccttgagggattgaaggtctcatttgaaagatgaaacaaacttcataactgaggtattatgaagagcatagtatttgaaccaagcagatggcgtttagcccctctaatttctagttggcatcttgggcgagtctcatatatatctgtctcagttatttctcaaataacacggagaagtaagacctccttcacaggattatacattatgtgatttttttttaatgagaaagcatttaccagttgtaaagcattaggggtgcagacctcagaacttgatgaaacactaaatcacgacacaaggcaacatagacaacaggtgctgggtgagtctggagggaggttgggttgacaggtgtgcttgtatgagtgtggtgggatgggtatgagtaggccttacagaggggatgggctgaagctgagcctggggccagggacaagaaggaagagagggcctgttttagacagaggatgcagttctgccaagggatggaggctcaaaggaagaagaacagcagaaggcaggccagcctgacagagtagacaggtcacggtgagaagtgttgggaaagagtgttgggaagaatgaaggaaaagacaaatcggggcttcggatgcatcaagtccatggacaatgggaaacatcaaaggtttcctgtgcatgaaagtggcctgattaaagcattattttaggaataataaccttagaatcacataaaggatgggtcagagagagagaaaaagagaatgtgtgaacctggaaagatgaagaccagtttgaagaacaatgagactctcagggtggcagtggtgagacttgaaccagttgtaggctttgagaatgaaaaagagagtttggaggaagagagagtgcaataggagaatgctctagacttggctactgatcaacaatgaaggcagcaatagaaaggagcaggaagtgtttagtgcctagaaaatagaagaaaaagaccaggagcagtggctcacgtctgtaatcccagcactttgggaggtcgaggtgggtggatcacaaggtcaggagttcaagaccagcctggccaagatggtgaaaccccgtctctactaaaaatacaaaaattagcctgtcatggtggcatgtttctgtaatcccagctactcgggaggctgaggcagagaattgcttaaacccaggaggcagaggttgcagtgagctaagatcgtaccactgcactccagcctgagcaacagagtgagactctgtctcaaaaaaaaaaaaaaaaaaagaaagaaaagaaaatagaagaaaaaaggagttcaagaagagctcaactcagaggaaaaggatacaaattgatgtatgcaatgttagacatacatgataagagaacatccaagtgaaactatctagatgatagcagggctctgggtgtagaacaattcacataaagataacaaggagaatatgccaagctcaccagggatgaaggtagaggcagaagatgaacacttatggggtgagcctcgagctgttccacatttaaacaacaggtagaagacaggaaacagaatacattctgtaggagtgaaaagagtgtggctcctggtgtttgtaagtcattaaactgcactctaaaaacagaacagtagttgcttttcgtccaagcctgtaatctagaactgtcacactgaggacttctaaagctgggaacatagcatgggaaagggtctagatcacaactctctgaagactcagactctcacacctgaagtcctgctagggtcccacggatgatggccttagtactactgaaatgactaatcctatgtttttagatgtctgtgcccatatgtgcaccagaaacttagttgcaatgccattgtccattccttgcttcttctttgctaatcgtaacttgctaatcgggtcagtgaagtgctgggcaccaagtgaaatacttgcctttgcagactctcttgtagctaagactggatcctgagacacagttctggacaatgacgtgtgagcagggggctgctgggagccacggaaggcttttgccctccttcatggaaggttctctgttcatgcagctaaacatactcctcatttatgcaacgtacgttaccttttcagatccacagtggtgacattgaacacgactcctttcagccagaggatcatgaagaggcgctgagagaaaggacagttgccgatgctttctccatcgattccagcctggaaagaagagaaccagtgtcctgagtgggcaggtgcaattagcaaggggaacataagattgtaacacccaaatgcaggtctgaggagaccttactaaaaccatgtcccagcaacttcaaagggcggtagcctgatattattagtttttgccttaatgtccacgcagggcaatgcctggcagcatgtaagggctcaataaatacttgctgaattgaacttgatgattatgcagaatcataactttatgaaatcatagaacccttggggtaaaaatagacctgcaacatcacttagtctgacacaaatgatattggaatgccaacatctacacccccaagtaatcatctagtttctgcttgaatatctccactgaccagtcagttgtattaatatctctcaaagcagttcattctgaggattgctctaacaattagaaatgctttccttcggctacctagccaaaatatgttcctctgtagtttaccctcccccacccctcagtccttggatgtcatgaatataaatatctcagactttgatcccatctccctatatggaggctaatcaggaagctcaaggctttaatcaatacaccacttagttctggctagtacttggccttcactgtcaataatccattcatttgttacacttttactcaacaaatacatattgactatcagttatgtgcaagacactggagaaaattagccaggggattgaaaattgaattcctccaaggagcttatggccttctgtaggtgggcttggggataagacaggaacatatgtaaaaataacagaattattattgggtgttctgtgcttctgtcatttcatttcccttcctcaaaacagtaggcttttttaggtctgaaaagcaagtccatctttactgcacttctgagtgggctgcagatccctgaatttcataaagaattaatttcaagcaaacctatgaacaaacaaaaaaggttggggaattggtctctgtagaattcatttccatagggtggtttattggcccccaacataatacttagaggaagaaataacccatttgctccagactctgatgttggctgccctggaaaccatggcccccgcaggtggcctggcagggcattccactgacaggaagggcctgtgtgggccagggtactgaagactcgtacaaagctgtaaacaatccgaccaatatccaggaatgggggcttactgagttttttttttttttttttcaaaagaaagggagaaaacaaatgcgttctcgaagctcaacacactgttttctcccttgaggtttgttttgctatggcattcagatggggaggcagcgatgccttctttcatacattagaacctcattgtgtgcttttttctaccttgcaaattgctcccagcaggggctcaggtttataatggaaaactggaacttttgacagtgttggctgcatgtaattgctatgaaattacagttattttacctccctcttaactacaccaaaagccccactccctattcagttctcacttttcctcagtgctggaagcagacccacccctgagtcttgagaaagcacggactccgttatataaaatgggaaaggtaggagggtacagtgtgggcgctacaccttcccacggaggtaaagttaccaataaagcatgctcagacaggtggctatcaatttaataatagcttggtgctaacttgagtttatgatgtacgttccctaggaacttctcaagaagcacttgacaggtaccaggttctcggtcctttaagacatcccgacacaggaagaatttccccagggccagttatggtggaagtaacaagaggagaactgaagaaaaaagcaaaaacaaaaacagaagccagatccatatactgttatctgttttcctctggtggtggtggtgggaggataagggaattgaaggaggaactagcaaaatagtggacttctcaactacataaaaaattcatataataataatgttaataataacatatctatattgtcaggcattgttctaaaggatttacatatgttattaacttgtttatttctcctgagaagcctgtgaagtgggatattttcagcttttacaaatgtggaaatggaggcacagagagataaaataactggcctaaggttatcatcgtggtgaaaccaggacgaacgcaggtggtctggctagagatccagtgctctgagctgcatgcctggagccagcctgagggtccagccaggtaacaggtcctccccaggtgctggggagggctggtgttgaattgtatggacatcctctggtcagtgtgcaatcagctatgccaggagcatagggcatggtatccttcatggctccctacattttcattatgtcttattaatcttgtattaaactatgattctgggtttagtaaacaaaaattgtcaaagaccaatagaaatatgcgaggatgctaccatttactttcactgtctgggtgtccctctttcagcttcttctattccccttcaaatcccaacagccttgcggccctaagaaattgtttgttaaactcatgggttaaatatcgtgatctgtgacgaccatctgaaacatcaacagagaagaaccaggtggggctcagttgggccccacatcctgaaaagtgtgagggaaaacccaggtgtactttgttccagagagattttgagcactgggggccagggaccggcacaaaaacagtgtcctaggttgaatcatgttcccccaaattcatgtccccctggaatgtgtgcatgggaccttattgggaaacagggtccttgcaggtggaatcaacttgaagatgaggtcatattggattagaatgggctctaaacatgactgatgtccttacaagaagagggaaatttcggcacagacatgcagaggacaaagtcatgtgaagatgaaggcaatgattgaagtgatgtatctacaagccaacgaacgccaaggattggtggcagacaccaaaagctagaagagacaagtagagcctggctctgcccacaccttgattttgaacttctggcctccagaactgtgagagaatccgtttctgctgctatcagctatactatgtatagcaatttcttggaaactgatgcaatcagggaagtgtcaaaaagacaattatatatatatatatatatatatatatatatatatatatatatatatatatataaacagctaatggcaaacttcccaagctcatgattctgctttgaacatgattgccagctataatcctaaagtacttcctgttccctagatacagtgtatataacaacttattataaaatatcatgccacatataatattccatatggtgataccagtagtagtagcataatgtaattatataggctgtatgattgcacttcatctgttatatgctggatacttcatattatatgctattatatattgcctttcatgtgagctctctccatatatgatgagcttggctccctcaaaacatagttgaagttttatttactttgtcttcagcagcaacaagcacaggcacctgaaacttactttatattcagtgcctatttaaatggatgcatgctgaggggagggtgatgtccctccctttttgtggcttgaggatctcaaaattctctcactgacattctgaaaatcatcctaaaatacatgcatacatactacatacatacatacatactacatacatacatacatggttaccctgagttatgtagcacactagccggagactgtggttctagatccatctctgcctctacttcactatgtgaattaccttagataagttaccccctcttggcctcaaccactgcacctataacttcctgcaattttgtaaattcaagtggaaaatggagatttatttaagaccgcggttctcaaactttttagtcttagaactcttttatgcttttaaggattgttgaggatcccagaaaggttttgtttatgtggatgatagttattgatatttaccgtgttgtaagttaaagctgaaaaacatttaaatatttagaaaaatgctataataaatgtgtctattaacatacacaacatcttaacacaaaataactatattttctaaaaacaagaaatttagtaaaagtggcaatgttttatatttttacaaaatctttaacatctgacttagtagaagtcggcttccacatttaatctcttggtatttagttggggtatatggggcttttgttgttgttgttgttgttgtttttgaaacagagtcttgctctgtcatccaggctggagtgcagtggcgcgatctcagcttattgcaacttctgcctcccaggcagtaaatactgacaaatattaagtctgagtaagcatggtgtgtcagccagttgctctttcaggtaaaaactgctttgtgagggaggcagctggttcagctggcaactcaatcatacaagtgcttttccttccacaaccatcagactttggaatgcagccaaagagcttatgtgcatttcccatttcatcaaccagaatgtttagaagacatgtatgcaaaggttgagatttaatcacattatataatttttaatgcttcatcaaggacattcataattgaggctattttttttttctgcacatgcatgactggctagtcacacttataccactgcttggatttgtgctgaaacactagtaaacttacccacgaaataccaatcccagagagagaagcataccatattgatataactctaaaaatagttgtgacctcttaaaacccctgaaagcctcttagcgaccccagaagtccatgaacaacattggagaaccattgttttaagacattccatgaacacaccagatatgtaatacttggtttccagataatgaaggggaagctgataattggccaaaagtcactcgcgggtacccaagtccagaagtgggaggaatcattcagagaggatccaagaaggaattatagaaagtgaccagatgacattgaagcttgatagatgagtcagttatcaatttattgcctttcagctccaatgcacccttgaatatatgctctgtgagaacagggggaatttctttaaacatttctcctttaaagtgagcacaaagttaggctttctcaccagggagaactagaggggcactgcaggaggaagaggctttcttgctggctgtggtgtgggctgggggtgggcagtgtagctgtgagggcacgcagtggagccaccccagctataggctcagcatgcaacccccctggcacctcatagcctcagcctggcaataaccttcccagcactcttgacacagaaaccaaagtccccattaagcctatgtccagtcggcctatggccagtgtgtccacacagcttggtcaccccctttgcaagccccacgtgtcctgaaggccttcttctccactaacacctagatcctgctgcatgctgtaccgatgctgattgcctgctccctgcctgaactctggggagtgggctattgcttgctcagcgactccagaccagctctggcctgatcaaaccagtgagtttctgtgccaggttccaaaccacttctaagtttgtccttccctggctcctctccctcagccctagggtaccatagagagtttccttatatgtcatggttactcttttatcttagttaaaacttcatgttgaatttctcctgtttaagctaccatgtagtttctcactcctgattggacccagactacatcagatgcttaaatgtctgttatttcaaaatgtaagatttttgtgacctttgacttctttaaaaacctggcaaggttaagtcctggatgaagtattaggaaagaaacctcagttttctcaagaaagataattaagtcaccacttacgtcacatttccactttttgttgctgtcgcccatgaaacttgtccctgaggactcaagtgattaaataattttgttaagtgtacagataaaaattaagcaacagtagggctgtaactgacctcaggaatgctatactccagttctttctttttactggtagagaaatagacccagaaaggttaaatgaattgcccatggtagcacagctggttcccatagcagaatcaggtctctctaactcctgactctcagttctgagcagaccacactggctgctgtcctctagaaaagagtgacaaagtggcaaaggccacatgaaaaggactttctttaaacataatagctcatttaaactgtttagacaaagaagctttctttataataatatttccagctgcccattttttaattagttagtgtaagtcagacaacatttctagttgtgactattttttttttaataccaaacagtctatccttccaataatttggttggcaagacttcaattagcagggatgggacttggtggtacgtggtccacatgaggacagagaggtctacccttgaagaaatcaacatttcctttctcagaagccacaaaaggcctaattcactggggtcacccaggcatttttcattcaagaaacaggtaacaggtatacatttgaggctacagagatcctcaacatttatctaaagtttaatgtatgggcttaattagctctatgtagaccactacctgtgcaatgtgatatgaagaattctaggtatattggtcagagttctccagagacagaaccagcacaacatgtatgtgtgtgtgtgtgtgtatttatatatacatacacatatatgtacatacacacacacacacacacacacacacacacatcctgttatatctactatatatggagaaacgtatacacatcttatttttatataatacattataataacataatattatatatatgtgtgtgtatatatatatacacatatatataatacatatcagttggggtgtgaagagagagagatttattttaaggaactggctcacacagttgtggaggcttggtgtgttcagaatctgcagggtaggccagcaggctgaagccccggggaagagccgcagttcgagtccaaaggcagcctgctggcagaattcccatttcttcagaggagggggtcagtctttttttctatgaggcctacccacactataaagggcaatctgctttactcaaagttcaccaatttaaatgttaatgtcatccaaaaaaaaaaaaaaaaaagcaccttcacagaagcatccagagtaatgtctggtcaatatctgggcactatggcccagccaagttgatatataaagttaaccattacacctggcatatttaaatattttacttgattcaggtaacctattaattcagtagctgtcatctgcaccttagctcaccagatggttttgtaaacaattgaatatagttgtgtacatgtcccctcccaaaagaacttgtaggctccagacttagcgggctccttggtttacgcctctaagtgagcaggatccagtggtgcctttgatgcataactagcctggtctgatggtggctttgggcccaaggctgcctacaactttgtatgttgcacagtgccactgtgttcatggcccattggggtgtctgtcctttagcctgccttgagctttacgtccatctgccactgagtgtatgttcaccctcctgtgcttcacacactctctgagaaagaactgccctttccaactcatcaccactgtcccttctcccagccccttctttctactcctacatggcttcttttctattatttcatgtcccgctatttgaataaatgaatgggtttcttttaaacctcttgccagcctttcttctatttaacaacttctgaaattgttgtctttcaatctgtttccgggttaatcaattcttttttttttcctttgtgtcttcatcctacctgatattcgtcttatagctaaaacttttgattatcctttcttcttaaagctcagccatctgcagcctcccttgccacttggtgcctcttaggtgggaggagccagcttaacaggcaggcagtctgtgcagttgcatggggccccattaaacttggtttaatgctctgctgttgctatcctgaaattcttaataattttggagcatagggtccctcattttcatttggcagtaggcactgcacattatgcactggcctgcctgtggaccccttatttttcttgctgacatcctcctttttctggcatttgccctctcagctcaccactcttctcctccatgcttggtgctctttggagaacttaccttgagaacatgactgtccttcccaagtcagcaataactctggcttctaggcctataaacatgctacttaccctaagcttaaaaaaaaaaagtagaaaggaaagtcagagaaggaaagaaaacaagggaaaatgttgaaaggcttgcttggctcaagtctcccttgttggttccacctcctagcctatctcactgcaatgtcatatgttattctagaatttgcctcatttcaattaaatatcttgccagttactagatacttgaggttttcttataagtcagacaatatgccttgttattactatttttcaaaactaaatgatctgaccttccaataatctagttgctatgctccattagcatgaatgtgactcagtgatttgttttatttatctactctcagaaacctgtaagtactcaagaaatgtaagactgatggccttggtatgtcttccaagtgattccaccaatcttgggaaggaagaatggttctcatatgttaatattatcaaccttcaccatgccttgggagagcccaaagtccacactctctgcctccaagtttggctgtttctgctcactagcccaggtgtaatatttaacagctaaattccattgcagtagaggcagatttcagtcctcagcttcacagaatactgtggtacagtattaagggcattgtatagactcatgcaaacctgggttcaaattcctcccctgacaccaaccagcagaaaaaatgtctgcagcactatttccaatcccgtatgtccttcataacctttccacagccccagctagaggtggagtccacatttcccttcttcttaaaatagggcaggcttttgtgactgcctggatgaatggaatatggcagaagtgacacaatgtgtgacttctgagattaggtaatagggggtgatacagcttctgcctgtgtctctctctctgtctcttttgggatgcttgcccctggaacctagccaccatgttgtgaggaagcccagagcacatgaagaggttctctgtagtgttccagctaatagtctcagcaacgttttcagatgacagattgcctcaacaaccagacaagagaatgaatgagatttcagattattccagcccccagcttttgaattgtcccaaatgacatctagtgaagtaaaattagccattctaaccaagtcctggccaaatgcaggtttttgagcaaaataaatgttgttattgtttaaaaccactaagttttgggctggtttgttactcagcaggcaactcacatacacacttagcttcaggccccttatcttcaaattggtggcagagttgtataattggatgacaatatgtataaaacatatagtatttactttatacatttacagctactgtctttatggccgcagaaggcaaacatttaggaagagcttgttaaacaccctatttatgaaatattatgccttgatgaagagtcaatagacctctctttgatggcacaaaagttcaacagtacctagcgttcagggttttgtgtatgaagcaataaattcaacaaagaaagaaaatacatgaagaactacagctattgttcattggccagaggagagtgttcctaaactaggtcagtcatgcatttactatgaagggagagagggaaaagtgactcatgtttggttaactattggtacaatgatagatacatgcatgtctgttctctataagactattgaatttctgtgaaaagcaacaccctccaaccaaacacctttttcaagtagttcaagagtcaaagatgagaagggctggaacccaaggaatatagatggttgaagctaagggatcaggtccgggacagattcctggaagttttctattgaagtttattggaagcctttgtgttctctcaacatccggaaacattttcacagctctttaaggtactgtcatcctattctttagacctgattaaggctctcaatgcttggttcaggaaagttgaaatctggaattcttccacctcagaaatgtaccaaaacacaggaaaccaaagagcaatacaaatctatagcctcaaataaacagaactcctttccacattggtataatttgaagaagaggtctcctcacttaagcctcccttggagaatccccatcctaatacaggaaatatgttttccacttaatgaggccactgtcaaaagctttgctttcctctcttgacatttttcttatttgttatccaagatgctatggaaattaatggcagctcttgatcgtgaatccattccccctatatttaaggaataagcctgcaattcctataatcctcataccaaacaaggatatcttgatattgagctctgctactcctacaaaggttggtgtttgggatcctgacatagctgagattcctcaattattactcatctgcccttctgttctggttgtctgaatgttgagttttgaatatagcctcttaataggataagctgggctggaaagactttagagacatcccaaaatctgtcatcctagctctctgttggcttcaataatcactcatgaatcccaaactcaaatataacaaattgaaagcttatgacactaaaatgaaatctgagtcctgaggtttattaattagggtcatgtacatctgagaacttatgaaaaaagtttttgcaaaattactagtttatgatatgtcaacaaagtatgtttttagagctcgaaaattccacacaactaagcattttaaaaactggaatgcccaagccccactctcagatattctgatttaattagtctgggggtagggctcagacatcagaattcttttccctcaatgttctcgaggtgattctaatgttcagtcaggactgacaacttctgacctagtggtgcccacagtgggagatgtccaacagaatcaccaaaggagcttgttaaacaaacaaagaaacaaatgagctccctgacctcactgtagacttgcagcatcagagtctctgggctcaggagatgtgtgacgggctggaccaaccaccgacagtagcacttaggacgttgtttctccctcctctttttgtttcctttttccttacctaaactggaaactccttcacatcctggccccactcctacttcccaccccatttctacactgttcttcttcaccttccatccctgcacaggccctgaaagaagtgcaccattttgagttgttcagggcatggagagcccattttggatcaagatgtctgaagaacctcaagtcaatgcagccataaacaatgccaagaacttcacgtgccaactgatatttttatggttgcatctccacacagaactcttaagttctgccaggtgggtcttccctgagggtgacagagtgtgctgtgaccgggtacagaaaccctagtcactgggctcaagttctcatgtggtcaaccacaggccatatgtacccaaccacatttgttctctccagccaccttcctctagtcagccatggtgaaaaatgtggcttcttaaaaaatgcagggtcctcataaggtcctgttttgggctttcttggctgcgtggagtaccagcaagctgtatctccactctcaactatatgcaggcacttggccacttgggcagggtggatccacacagccagatgggcatctttaccaagggccagcttggttccagagactggggatgtagtgatgtggtgatgaaagagacatggtccctctcttgagaagctatcacacaacagaggcagcaaaaggtaaagacatgatggccaggtcatcactgaagtgcagtagtagtagagaatgggtggagtggggacaggaaggagcccacctaagggttcacggaaggatttggggcagcaacaatgcctaatgtgagcctcaaaggtaagagagtttattcatacaaagtggcaggtaaggccatccaggcagaagtgatggcataagcacatgcctggaggctggattgaacaatgcaggtgtattaggctgtttttgtgttctgtaaagaaatacctgagactgggtaatttatattgaaaagagatttagttggctgatggtcctgcaggctgtacaagtgccatgccagcatttgcttagcttctggttagggcctcaggaagcttatgatcatagtggaaagcaaaatgggagcaggcactttccatggcaaaagcaggggcaagagagagagagagagaggaaccaggatcctttaaaccacagctctcctgtgaactatcagagcgagaactcactcattaccatggggagggcacaaagtcaggagggaaccaaccccatgatccaaacacctcccaccaggccctgcctccaatattgggaatcacatttcaacatgagatttggcggggacacacattcaaaccatatcagtgggtgtgcagggaattccaagcagatcttcttcatgctctattaggaaaacccatgcagaatttctctagttccctttcttcctccattctgaggaccccagcctagtcacaggcaaagccataaggcagtcaaatgctcatcttctgggggtctctgtgtcttcccaatctgctatctccaccatcatgcatctctaaacccctcagccactcttggccagcatgcctctccccacttgtatctctcaatgccaactctgaaagcattcacatttaagtatgaattgttggtaactgctaagcacttattcctcctggggtacttttatttatcatggcccagatgtaagcaacgagatgaagcttcaatagtggggttgcaggtgtctgccagaaactgattaaagaactgggaaagaaggaagaagggcaacaatagcttcctgggggtcctgaaaccagacatgtaggtttttatctattatctcctatgtgagatcctgccaacttgttacttctgcagctctgaaaaactagctcacacaatggatgccccagaccaaagggcaggcactcttatcacaaaactgccttaatttccatttaaaattttctatttaaaattacttcaaggctggttggaagggcaagacttcaaaaacaacacattcctttttaattaattggaggcgggtgactataggaatgttttagctttgccgttaatatgagtgctatgaatttgtaatagtgacatcttcctatacttgtgcagtaagatgtttgttagcaagaatgtttggagaagcaagatgttccctggtgaactgaattccctgggtagccctttaagcaatttggggcaatgtaataaaaagcagaagattaagagttctgcgttccagacctagttttggcacaaagagttgtgtgacctagggcaagtaattttccctctctgggtcttaatcttgttatttttaaagtgaataaattagaaaagatgggcttgaaagacactctgttcctaaaatgtggctaggagaaggtgaaaataactaaatcttttatttgcacctaaaaattccaatggctgagtagagactccacaagctactacagtcctctctcccagcaccatgcatggctcacagcacgggctggataaatgtttgccgagaggatgaaagagcttgtggactagcattctattctgaaaacacaggcagctggatctgcaggggaggggccagcactgtagattgcaaggaaaatcaggccacaaaggaagaaccacctgtgaccacctttgctagctgcttctgggctctgccttctcacaacttctctgtagcatctttccatagtattctcagcaccttaccttaaaaagcagttgaagaagcaccctttttggaaggctgtccccaccccatgtccccgcccccaccccctcctgctctatccaactccttcagactagggcagttgagatccaaagacttcagatgacttttccaaggccacatagacgatcggtagggatggagtttgctattgaatggagatggctgaaatctcagtcaaaatcgtgaacgtatgtaatttagacataatcagggaagacaggaaaaacagaactgaatcctttggaaagtcatcttcgagagatgttcctgctaacccttgcttatctttcattttattcccttaaaagagtaaactgctgaagacagaggaagaaaaatcctgccttgttattgaatggtatggattcacattcacatcaaggtttttttttttttttttttttttaatcgtggaggatttactcagggtaaagacagaaagccacactcctacgacaggtcctgagctcccaggggaaggatagaagggaagctgtgtagctgtcttttctcactatgttccttcttctcccgcctagggtgattgggaggattaggggagataacacaagtaaaatgggggcgcagtgcctggcagaaagcactcagtgcatctgccatcttcaaggtcactctgccctctgggcccattcctccttcctccctctcctcacccccagccagcacattaaaggtcacaggtctggagaaagtccttctctgccactgtgcaacagggaaatgtttctcccagccaagtgcccctgtcatgtgggcccacccaactaatttcttctgagcccctatagaacttacagtgaagactgtggttagtcctggatgattatatcttctgctttagaagggagctttgaaaacagcctcacaattacagaaaaaaccaagccagtttttgtgtcaagaagacccaatttcgttttctcagccttgaaaaaaaatcaatttgaacttgctgctggctgagttatatgttcaagctcagaccgagctgtaattggaaaggagtctgtcttttgtaatccccaggccaaaaggggaaatgaaaatctttttcaaatggcagagtaaggcaggaaatgttctctttattgtactcccataaaaaaataaacctacccagtaattataccacacacacacaatagtccaggccctcacccaggaagccacaacctgagatgaaggagtcagtggttattttcaaaaagggaatttttccaagccctaccatattttctctcacaagttcctttgcatttacaagagacagattgcccaccctgcttttctgcctgactggtggaagtcagacaacctgcatactggtcccagttgttctgcaagatgaatgtgcccttgagcaagtcactgtctcgatctggcattctgcacccttacctatgaaatgaagggacaactagacaatgcctacatctgaattctctgattctctttatgctcacttgttcattgggcacaaaggagtcagaggtgatccctgcttatgaaaagctctaatgtaaattctccactttatgtctaggagaaaaaactgaaagtggccattataaaaatacaaaactgccccattggtggactccaaaataaatgaggtacagaaattgttctttttcctctactggatcctttctgtaagtcttagaatttgctatgatgctcttggggcattcaaattcacaagcacaaaaagaactacattttgggtaccacattctaatactactatccacagagtggattcctcaaatcagccatctggtatatagaatatgtgaaaatgcatttccagttctagcagagattgttccatccataggtctagagtagaagtatatgtaatcgttgacaatcaacaaagcatatcacttatatcttatttagtttgaaggtgccgaacagggttgttgtacatgtttttaaaaaaattttattatggtcatctcgtctccacccaaacccccaccaaactatttctaccctcttaagccagggtgagccaaagtcccaacctttcctttacgtacaagacccacctaaggaaggaagcctgctattgttggactatgtttagaacagatgatgctacgtgatgaacttcgagcattaatgacagatagtcttctagatcctatctaatgtttaggatcagccccttcaaattgttttttgatggagcctcaggaatggcaaagaaacattgcaacttgtgcttcatctgccaattattgaaggaggctgctggaaacataatatagaaaattctgaggtctcaactaggattcgtaggacagaatgtaagcattatttggtgatgacatgttttatttataaagtcaaccttagatgcaattctgctgactcttctacacagagaagaggcctgctgaagaattaaaagataagaacaaagctaaaatgagaagcataattttcccctatgtcctcctagttagctcttatggacctttctgtaacatgagtttcttctactaagttgtaaaacagatcctgttttacttttctcttctcagtcctatgatacagttcagggccagacacatttactctagttgttcaaaatgtagcctgcatgaaaagaccagtgtctcagagacataccaaagggcagaacagaaacaaggcttagaaacaaatttaacataagtagagtatgggtatcaaggacttttactgtatagcgcttgcaattatgtgattagctttcagcaagatgtgttttctctctatcttttcaaccagaaaataatttaaaaaacaaagataacttgaattggcctcaaagctgtctccatccctgtaattgggaataataacagctgcccacctacttcacgagttctctgtgaggatcaaaggtgctctgaaaggatgacatacaataatggaacctaccactgccatatcctgtcttctttgttagtggattgaaattccagctagaacacaatgtcctacagctccagggtcctcttgtaagtttatctctcaatcaagtctcattaagagctttttatctctcccctggaactcccagaaaaggccctaagagggatagttttcttgttaggaggaaattctgggttgtctgcagccttgctgctcaaagtaggtccacagaccagcaacatcagcatcctttaggagctcattagaaatgaagattctcaggccagccccatacttactgaatcagaacctgcattttcagtaagacctctaagtgatttatgcctcttagtgtttgagaaggctggtcttcagaacctttgcaagataaaggcctcatacagcaacaatcggaagacctttaaaaccgatgcattgggtcagtgatagccagcttttctttttcatttaaaaagtgcatctttgcacatccagatttcacataattcttggttaggaaaaacaaaaagaaaaacaaaaacaaaactccactcttgttcatagtaatctggccctactgggttctaaaaatgtcagtgaatctctgccaaatttccatacctcgtgcagaggaggagcctgcttgcaaataacaatggcagccaggtgctgaaagtggacactgaagctgaaactggagctgaggttaaattatttattgaaattccatgacttggcttgtctgttagaagccaaccaaacctagagtcactgagcatgttcatctcgaacaggccccatcctgcaccccctgaagttacctgcctctttgcctgtgggaccagtcagatgtcggaccctacctccaggggttaagttatggaaacatgacatggctgggttagtaaactgggctctctaaaggtgctgtcctgagagctcctgatgcccatggctgagcagttcagtggcttagcagtctgcctctgtgcaacctctagttcatagaaagcctgcctgttgcaggaaaaataactcgcttgcagctaactctttcttttcattttttaaaatgaacaccctttgtctcagggtttctatttgtatgacagagagaaatgtgtttttttgtgggtgtttttgtttgtttgtttgtttttgccaaccaacatcccaatatatataaaatgaattaaaccctgtagatatatattccttttacaatataatcactaatatttgatcctcaaaagcaaaatactatgaaaacatgttcatcaatagcagaataggtggccgggcacagtggcccatgcctgtaatcccagcactttgggaggccgaggcgggcggatcatgagatcaagagattgagaccatcctggacaacatggttaaaccccatctctactaaaaaattagctgggggtggtggcacatgcctgtagtctcagctacttgggaggctgaggcaggagaatcacttgaacccaggaggcagaggttgcagtgagccgagatggcgccactgcactccagcctggcaacagagcaagactccatctcaaaaaaaaaaaaagcagaatagttgattacaatgtgatataaccatatgatagaatagtatacagctatttaaaagcatgagtttgattcttatgtattattctagagggagtgtcacagtaggagaaaaaggcaaatgacaaagtaataagaacagtgtgatccctttttgtatttaaaaacaaaatcttgcatgtgttcgtattgtacgtgtgagagagaggagaaatatatatagttttatatataaaaccaccaggctgggaatcagaaatcctgggtttctgtccttatgctcccctgagaagtgggggctgctcatctctgggcctctgacaccttctctgcctatcagtcagagtgacagcaagagtcaaatgagaccatgtgcatataagggctctgaccagtggaagtgattatagcttccaggcacctatggaaagatgaaggttaatataacaattatatttatatatagggcagaatgaaataaatggtaaataggagactcaacaatatgtttttcatgtcttgggaagcagtgtttactactgtgtgtgtgtgtgtatatatatatatatatatatatatagagagagagagagagagagagagagagagagagagagagagaaagagagagagagagggcatgccatagagaggagttgagggcaggacctgatactgataacatcagtttcttcaggtgggtgcattcaaggggtgtgtgaaaggagagtcttcatattttctttatgtggtttcaagcaaagaaatatttgaaacccttgggaacagatgtgtttcaaaattcaaaatattttggaatgtagaaaggtaacatgtgtggatatatatgtaaccccatccccaccccctgcaggctctgggacaccacactgctgtaatcaagtctgttataatcacatctccacagcaccaagtggggcaaagatggactacaaatcatctctaaagttcaaggaagttttgcctcaaagtgaatttccacaaacttatgaaagaacttacagttttcagagctttttgaatttcaggattacagataaagaattgtagacctatatatttctttaaggtttgagttgtcacagtcatcttgtatttttaaaacaaataaagtaagctaaaagggaggtgacaaaaaaagaaagaatatatgaagaggaaaacccctctgatctgcccttgggtccctttacttgtgcctccaaaggctctgatttagaactggagagtgagcaggatgtagctttggtgaggcacactcaggggtcggcctgacctggggactggaaaccccagcaaattcaagcccactagcctgccatgtagcagatacaggagaatggcaaataaagatgaaagaaagacttttaatgaaatagaaagtaacttaggtgccaaggagtaaccagatcctaaagtgatgcccacgtggctcctgtcattcgatatgcaactgaaacaaaagtatttctgtcaaagttaaaatgtatattttaactttggccaacagtgactgtccaacacatgtatagatggcatcctcagtccagtgtgccaggaaccagtggtgccctcagattctcattggggcaggcaagtgcttgtttctgtctaggtctctatcaatatggacatttattttaaatatatatgtatatagttatgttgctaatcttaaaaaaaatcttgaaatgtgctttaaatccaagtatatcagattacaaagaacaagacaatatgttacctgtcaatctctaaggtgcaactgctgtacaacttgagccaagttagctggagccttcatttctcttactatgaaataggggtacagtaccattcatcaccctcacttgaaaggtatacaatataattaaaaagtgcttaaaagtctttggcttaatttatgttgtaaattataaatagcctatttctctatgttatataggtaaaggaccagggcctgaatgtcataaagagaatgtaaatgatcagtgatggaaaaaaaaccaccagactgggaatcagaaatcctgggttcctgtgctgatgctcccctaagaagtgggggctgctcatctctgggcctctgacaccttctctgcctatcacaaagagtgacagcaagggtcaaatgagaccatgtgcatagaagggctctgatcagtggaagtgattatagcttccagtcacctatggagagatgaaggttaatataataattatattacgtatacggcagaatggaataaatggtaaataggagactcaacaatatgtttttcatgtcttgggaagcagcgtttactactgggtgggacatcggaaaagtgtcctttcatttttattattttcttggtagatttgttttttgtctgcttgtttctttctttgttaaatgtgtagtgtgagtagacatcccagcttgcctaggactgggggaattccaggactttcaggatttaaaactgggaaggtccctggaaaactgggatgagttggtcactctatgtacatgcatttctactttcagaaaagaatttgaaggcatggttagacatagaagcttacatttaataaaggttggtgcaaacgtaattgctgtttttgccattacttttaatggcaaactcattcatacaatgcccatgcacagacagactttattcaattcaaagcagttaaaaatgtcaaataaccccttcttagtacttttggttcatcgtactacagttttgtccttcactggatcaaacgtagtgattctcagtattaataatcactccagactctgtctaaatattcaaatgggtaatggacattataatggcatagacctatgaggtttcctaacattaactagaatagacaaaaggcagcttgtcggaaaataacactaacaacaacaaaagggatattgctgatgctttttagggctggatgttacgtgtgtgctgtatgtatgcaatgtgcatattgtcttcccatgtttggttgacttttcattgctaaatgagcaatgtagttcatacagatctgcccacatatcaaaagaataaattatttcctttcagggctttgtcttttgcaagaaagtggtgtttaaactatatagttgatttataataaatatttgtaataaatatttattttaaataaacagattgggtgattatttttatttcacccttgaataacaaggattatagtaactttttcattctttatttttgactttgtggccttttggattttgcatgctttttcctatgactccacttcaggtgtttatagtgaaacataaacctctttttatcaaattccagtgcaagctttaatgacaagcatattgtaattattcttgctacattcaaattgtaatgaatcaaaatggtatgtggctttttttgaaagatgatcttttagttgctatttcaacaaaccccccagatctggagcccagctaccttccctccatcttttgtaaattaaaaataaaaaaatggatatgatacaatatcctaaattatttctttggcccttttgagcccatactcagaaccctccaatgactttgcactaataataggataaaattcaaactccttgagctgcctctcagggaccctttctttttccagggttataaattctcccctttcaagacctcttcccctgcctcccctcccctctaggcaaacagcttgcccacctcctctgactaggctcaggttggctatgtctgcacttttgttcatgtcatttctctcttttggacagcattatctgtctctactttcaaatactaactcagaccccatcttccctggaaatcctcttcagactacttctattagaattatgttgtgtatagttcatttcattcattcacttgacaaatactaaacatcaacaatgtgtggggtgctgttctaggtgcaagggatgcccagtgggtttccactcagcgtctttccctgtagcttgctgcagtggtggggtttttctctggaagcaacagagcaagaagacaaaagacaatagcagggaagctcctgggctttgggtctgactaggctttgccacttactagggttgtaatcttgggaaagtttcctggcttcagtttgctcctcagtaaagtagaaatatggtgtggtacttaaaaagttgtggtgtgaatttattgtccatgtaaagcatttagggatagtttgtggtgcaaaataactgctcaataaacagcattacattatgatcttatacctggtctgacccatctatggtgccttttttcccctcagtgctttccatatccgagaacttagtgttgggcttccttgtcattgtgtgataaaatactcttctctttgactggggatggctaacaatgagtgattcctgagcaggaatcgtaagctttccaataaaaatatatgtggggattcttaaatattttaaatatttcagtgaaggtctatggggattctaggaagtattcaacaatatttattaagaacttctagaacagtggttctccaatgttagcatgcatcagaaccatttgaaagccttgttaaaacacagtaggtccagggtggggcccaagaatttgcatgtctaacacttttacaagtgatgctgaggcttctagtgtagggtccacacttggagaacatctgtactagaagttgggattgaaaataattatgaggctgggcgcagtggctcatgcctgtaatcccagtactttgggaggctgaggcgagtggatcacctgaagtcaggagtccagctgacccacatagtgaaatcccatctctactaaaaatacaaacattagccgggcatggtggcacatgcctttaatcccagctacttgggaggctgaggtaggagaatggcttgaacccaggatgcggaggttgcagtgagccaagattgcaccattgcactccagcctgggcaacaagagcaaaactccattaaaaaaaaaaaaaacagaaaataattatgagagagctgtggatcagccttccaaaggagctcaacagccagagtttgaaaaaaaatgcacaacagggtgggatacacaacagccacggaccaggttagacaacactaagtggagccctggttccattattcactgggatataaccttggacaagtcatttacctcctctgagctttgttttccttattcaaaaatgttagaataagaatcttccctttatatctcacagtgccatgaagacccaggacacatgtattatatgtgctaactgaagaccaatcttcaaagttcaggggaaggggcatttcctcccctttctccagtccaaagtaactccttgaatagacaagagaccctctaagcatgtcacgttctttcctcattcactaaggcattgttcaatatcttaaagactgaactagctgaatagattccctggtaactcaaaaccttaaagcagctttgaattaagagcctgtctctgggaagtgacatttagggaaggtccactaaggctatgtgggctccacccactcttccagccttctgccttgtcctgaatcacattgggctgacaagattagatattcctactgcataagattagcacctgtgaaaaatcattctccttgaatcacattttaatgccctggcctcagtttttacagttactagatgaaataatcacccaaaatttctactgcattttctatttaaaaaacgttgatggcattgttcattatatttttgagtgatccccacacactacttataaaccattacatgagaaatggccttttagacctttgtgagatgcatcatagtatgcaaatattttctcccgttctgtaggttgtctgtttactctctctgttgatagtttcttttgctatgcagaggttcttttagtttaaccaggttccatttatcaattttttatttctgttgcaattgcttttggagacttagtcactttttttttttttttttttgccaaggttgatgtctagaatggcatttcctaggttttcttctaggaattttatagttttaggtctaacagttaagtctttaatccatcttgagttaatttttgtatgtggtgaaaggtaggggttgagtttcaatcttctgcatatggccagcctgttatcccagcactgtttattgaacagggagtcctttctccattgcttgttattgtcaaccttgctgaagatctggccttaggcatggggctttatttctgggttctttatcctgtttcactggtctatgtgtctgtttttatgccagtaccatgctgtttcaggtagcaaataaaggcaggaacataaaaccaaatactgcatgttcttacttataagtgggaactaaacattgaatacacatggccataaagatgggaataatagacactagggactactagagggggtagagtgggagtggggtgagcattggaaaactacctattgtgtactatgctcactacctgggtgacggtgatcatttatataccaaacctcagcgacatggaatttacccatgtaacaaaccagcacatgtacccccaaaacaaaaataaaagttgaaaaaggagagagatggctttagaatctatcaccacaaagaaaagaatacttaatgttaagggaaaatgctagtgataaaatgttgtgaatagagcatgctgcaaaatgtatcggttgtataattccaataattaaaaaaaaaaaacctagaaagaaaccaaaacattatcagaagttatctaattacttttataaatagaaaaaaatatttttcaaagtaattcaatgacagggaatttcatcttctccaagaaattgtcttcttccactctcaaaaagagaattctataactcattgtgtcttttttccctccttgccttcttagaagctcaaagatcattatttgaagcatgcattgacccttattacaggttcatttagtgcttattttcattttctgttttgttttgttttgagacaagatctctctctgtagcccaggctgaagtgcagtggtgtgatctcggctcactgcagcctcaacctccagggctcaagcgatcttcccacctcagcctcctgagtagctgaaactacaatatttaccaccaggtctggctaatttttgtatttcttgtagagatgtggtttttccatgtttcccaggctggtcttgaaacctgagctcaagcaatccacccacctcagcctcccaaagtgttggaattacaggcatgagccaccgcacctggcctcattttctgtcttattgctatttcattttacacgtgcttactagatgagtagtatctacttatataatttctgaaattttgaaacatcctgaactttttacaaactaaataaggagccagaagtaagtgatatgtaagttccaagaaaattaaacaactagcttctaaatatacctcaaaaagtaatgtggtttctcaaggcttgtgctttgcagtgggcaaatctgatttatatatttatcaaagaccataatggatattacattccttttctgtaagcagttgatactcaatgagatacaatgtggactcccttagttaccacctctgtgggggccaggcctaggtgggaggaaaaccttgcactttcatattgctgttcagttttggtgggcatctaccaagggaaccactctggaggaagactctctgtctgatgaaatacaggggacaggccaggtgcggtggctcatgccaataatcccagcattttgggaggccaaggagggtggatcacctgaggatcaagatcagcatggccaacatgatgaaaccccatctctacaaaaatacaaaaaattatccgggcatgatggcaggtgcctgtaatcccagttactcgggaggctgaggcaggagaatctcttgaacctgggaggcagaggttgcagtgagctgagattgcagcattgtactccagcctgggtgatagagggagactccatctcaaaaaaaaaaaagaaaaaaagaaagaaatataggggacagtcaaggatgacactgaggttttgatcttggaatgttggaagatggcaaagacaatatgagaaacgggaaatgtgagggagctcagctttaggggaaggtttctgtgtaagaagaggtagctgtagaacctgtagtttggaaaggtgaacaaaccttggacacctaaccatgcaggggctgtgattcttgtcctgactccatcttatcagtttgggtcacctggggcctgtccttgctgctcctgcttgggactcagtgtcctcatgaatcaagcttgttcatctctaaggcatttccagtcctttcagtggatgagttcatgatattataaatttttttatacagtcacgaattgcttaataatagggatgcattctgagaaagggatctttaggtgattttgtcactgagcaaacatcatacagtgtacttacagaaacctagatagttccagcctactacacacctaggttatatagtgtagtctattgttcctaggctataaacctgtccagcatgttgctatattgaacaccgtaggcaactgtaacacaagggtaagtgtttgtgtatcaaaatatagaaaaagcataataaaaatacagtattataattttatgggaccaccgtcttctacggggtccgtcgttggctgaaacgttattatgtggtatgtgactctgcaactcatgagacattttacacatggagataaagacttgggtcaactctgtttgtctcagattgcatggctgcatagatgagtggttttaataagggacatttaagaagtcaatgattcgcttttagtactgactgacacttttatctcttttctgggaatcagtctaaatggcatgaatttggagtttgtaagagctgaaaagaataatgagaaatctagaaatggaataagccttggtaaaaggtgagaaacgattcaagcataaggtgaattactaaggctggttgcctacttttatgagctgcacagggaaaaggccacaaggtctgggaaatggaagaaaatgaaatgccaataaaacaaaggaggtgggcttccttgtaacgtacattcagtgagagatcataatgctcaacaaatctgttaaatcctcagacctctgcccagggactttttcactgcctgacctcacctgatctaaagttcatgcagcagcacagggagggagggtgagaggaatgctggggaggacttggatagtattcttactaggaagccataaaaatgcatatattctgggacagggtgtgtgctgtcatgcacagagccaccaaagtgtcatcaaatgagtagtgtccctatactacctagtgggagttgggtttgggtaagtgatgtcaatatacagccctcaggacaggaagaggaatgcttggcacaagacacaccattgagaagagttttgtaacaatcggttggaagagcgattgtggcattccttatagctccgctctggctaccctgctcctgcatatcacggccttaggagttacagacgcttgggatctctgagaagacacatagaagattcaggtatggactggctggcatgtaggcaacaggtaggacaaggtaggttgggggaatgcctgtgtaaagagagaatatagacaacccttcattcattcattcatttaaatgtatgcacacatccattcaatcaccaaatatttcctcacctggtaagggctaagaacctgccttcgggcctgaaatataatgcctttctcagataagtcttttatacccttctcccatttaaattagtcctccagttatttccttaatagcactttttatcacctgaaattacttgacttatttctttatatcttctctgtctcatccactagaacacaagactccttaagtcaggaaccatatctcttttgttcactgctgtagtcccagcactaaaatcaatgtccagcacatagtagggcctcagaaaaaccattttttgaaagaaaacatcatcacagagatgaatagaacctaggcccttcaagaaaagagtcaaagagagtgtgggaaagcacttagtggaacatagtaaaggaaagagaaaactagtacaaaaattgaattggttttcccctagagatttaaaaaagtacttgggattaaaagacaaataaaacattagaggagccatcagtgcattggttccttgtgctcaagatgagagggatgtgtagaattaattctcgagtactttccaggcctcctggcctgggagtctgctgtcttcaggtccgcaatgccagtactgtcacctgtgctatccctggactcaccatgttggggtggaagggacatttgacaggtgctccggaacccagcttgacattgacttctacccggctgtgtggctttgagacgagacagttgactttgggagcttcagcttttctctaccagtaaaatgagaatgacacttgtactaagtgccccgcctccacagttttgttttgaggttctaggtaatgtagtacgtgtgcttcataaactttgaaacaacatacagatgtttgcaaatgacaggtcaccaggatgctctcccctggtcactgcagggcaaggctttcatggtcttcttgccttcgctggggctagttacccacaaaatggagttctgatggtggactttaaaggaaaaacataagccattcagcgagcagctttgtttacagccatccattcaaaatcactaatgaagaattcattgaggtttccatgatgttttctttctttttaaagatgagatgactgggtctcaagaaatccttctttccctccaaagacattcatcgagcagctctatgcctggaactgtcttaataccagggaaacaaggtcggtaactgccatccttgacgtcatagctgcctcacggggaagacacagaacatttggcacactcatactcttataaggcaatgggatctgagcagtgaaaaagtgcatgggagatgtgggaacacccaagagagacactgaaattagcttggtcatgctggagggagggcctggaaaggccttctagaagctaagccctggcaaagggggtaaggaacatccacatagagagggaaacctgtgggagagaagaaagagcctggcccctctgggagccctgagctgttgttcagtgtggttgtcacttgggcagtgaggtagggagtggtaagagatgggcccagagagataacagggagcagatcatgaagcaattcattctaccttcagggtttaatctcatatactctaattttcaggcgagaatctaaaagttgctgtgccatttagtacagcagagcaggaagtatgtgtatttgacctccttgttaatttcttcccataggtacctttctgtaaaaagcaggctcatccccaaaacactgtgtttcaataagctcgatgcagtgcaacagtgaagtgactcctttcttagcagctgggttggaaatgcttctgtgtccctccagacctgctctctagcctcaccactctgcttggggcctggaggctgacagtgggaatagcatcaaggggctccctgccctctggctgcattaggatcagaagtcctaatgcacgcgaagttgggtatttattgccttggccccatccctaccaggccactctgggttggctgcatcccttttccaaaggtcatcctccttccagtgactctttttgggtaaagggtcagatctaagtaaagggtccttgtagttgttctcccatgtataggcctcaattatctcttgttggtgcctgatgtggtttggctgtgtacccacccaaatctcatcttgaattgtagctctcataattcccacctgtcatggcagggacccagtgggaggtaattgaatcatgggggtaggtctttcccgtgctagtaaataagtcttaggatatctgatagttttatagaggggagttcccctacacaagctctgtcttgcctgccacaatctaagacatgaccatgctcctcattcaccttccaccatgattgtgaggcctccccagccatgtggaactgtgagtcaattaaacctctttcctttataaattactcagtcttgggtatgtctttattagcagcatgagaacagactaacacagtgcctttaaccctgatcatgccctgagatcctgacacaccatcattgatttccccagcatcactggattctttggtgtaacaggaatgcagggtggtcagaatccttggtaccattgaataaagctacccagatggtgaggagcactaggttaggagtcaggaaacccagcttctactcccagcttggccaatgattagctgtgtgacctcaggcaggtaaaaatcctgccatgcattcattctgatgaaaggacattgtagcctaagaaggtagtgatgtctgcaaatggaaagggtagaattgtctgctccagctttttgtgagggtgccttaagggccactttggggtcaagaaggacacagccaggataagccagagaaggccttctttaaacttttttttctatagtgaggctccacacatgatttagttgacataacaaagaattccttgccaccaggaaacatttgaaaacaactgggctcaatgaagttatgaagtcctgtttggttttcagagctgagatttcctctgtgctcattcactgggtggagaccctggtaaggatacaatctcccctgcattccacaagtacagcagctagtagctaaaccacttgtggggtcacttaattgctttgattataaagaggcagtaaatgtgaccttgcccaacttaaaggagtcttgtgcagggacagaagaccctggggtcatattatttgtacacaattccaggatagcattaacctgagtcattttccatgaactactcacatgtatcagtggcagtgtgtctcacttgaaagtcagtgtgcctcttgtgttgcccatggaactggagacctgatactctttcactggcagccactggaagatgctgagaatagcaacatgagtggcactgtggacttaacccaagcatttgaccccattaacttagttggtatgtgggaagctctgcaaaatgtttgcttcctagagacacttattaacatcacttctcactctacaaaacctttcctgataattgtcctgccagaagttatggcccctccctctgaactcaacattcagcatgcttttctgctgccctttaaagttagattccagttggtgtgcacacctaagctctatctcttctgctaaactgtggtctccattggagaaagaaacatgttgtacacatgtctatattctctacagtgccttatagacagatgaaatccagaaagtgtttattgttttgttagctgacagtcagggttgacctgtgagggaactataagatagatttttgtatcgttgttataatcacaacaccaaagtcttagcctgttcagcctgccataacaaaatcctgtagattgtgtggcttaaataacaacaaaagaattatttttcacagttctggaagctgggaaatccaagatcaagatgccggctaatttgattgctgtgggggccttcttcctggtgtgcagatggctgccttccggctctgtcctcacttggtagacagagggagaaggagagggagagagagagagaatatctctcttcctcttgttataaatcccccaatcctattggattagggctacactcttatgacttcatttaaccttaattatttcctaaaagcactatctccagatacagtcacattgaggattaggatttcaacatatgaattggtgagcacaatttagtcaactgcattctgtccctggccccccaaagttcatggccttctcacatgcaatatgcatttattccaccccaacagccctaaaagtcttaactcattccagtgtcaattctaaagtctaaagtccaaagtcccatctaaatatcatctatatcaggtaagggtgaggcctgaggtgtgactcaacctgaggcaaaattccttcgcagctgtgaacctgtgaaatcagacacattacatgcttccaaaatgtaatgttgggataggcataggataaacattacaaaaaggagaaattggaaagaagagaggggtgatgggtcccaagcaagtccaaaacctagcaaggcaaattttattagatcttaaggtctgagaatagtcctttttagtttgatatcccaccttcttagcctgctggggtggcagttctgcccccatgactctgccaagtcaggttttcaattgattaagtctcagccacgttagggagggcaatctattttttctcagtccactaattcaaatgttaagctcacagatacactcaggataatgtttgatcaactatctgggcctcctatggcccagtcaagttgacatgaattaaccatcacaaggggctttaggaatcatctgatccagccatctctccaaagcatgaatccctgtggctacttgccattaaaaaacctgaggagattcatgccacgcttaactattatccttgttttagcagggttctattaaattgccttcaaaggttaagtttagattaaaattagaaagagtatgaaatcacagcataagcattttgagaacaaaggctgctgctgacttctcaagttcctcccttgcgctttgtggtgctggcccagccaatagtgtgagcacaggagggcagatcctttccaggtcaagacaaatggggtttctgccagactccgacctctggcaggctcagtgcagctgcagccactggcagagggggaatgacctggggagaaagctaaaggccagtctcagtctatgaggcttgggttctgaatacagagggtcagtacctagggtccaaggctctccccttcccaggtagcagcatgactcttctgcccccatggctagaactgctctgtagcctggaagtgctgatgtgcaggattctgtctgcctttctaggctgcatttgacatccatttgaatcttgtttcactcttgtcaaaatgttgggaggaggaagagacacacaacaggattgactctgacattaagtactctccccacccccaccgatgctttccaggtggtgttttaggagaacattgtctcctttcctgattgtcatcactaagacctgagacacccttttccagcttctctgacaattagcctcagcatcctgtggaagctgtagagctctataaatattctcattcctgatattatctctgtaaaaaaggtgatatcattttggctaggaaaagtcagaattgctttgaaattttggtaaaaacattaagaaaaatccccaaattgaaatgtagatcaatggaagtagttttctagattcaccagttttctatggtgataatattactgtttgaccagtatctccagtgctgcccttacaacatcgtactcatgacgttaataagcacgtaagtcaggtaatatagtttaatttgaatggtcaagtgagaaaggcccaccttgctctttatagcaatctctgcagtggttctgttttgtaaatagggaatattaaaatttaccagaagttagctggggcaaggtaggcatcccattaaagataccaaaattccccaatgggcagagttgcagggaaaataatatctgccctttagaataggaggcaatagtgaaaaccccacccctgggctagcaatttgaggaacttcaccatcaggacattgatggctaaactctgggtctaactcctgggtgtttctgtgtatctatgatgggattcatctcacatccatgcactctctccagcgacgtctccatccatatatgcatctttgttcttgagagggaagtgtagaataggagcttggaagtgaatccctatgcacaagaccctgcttttcctctgaaccaggcaaccttggggaagacatggagtttctccctgaaactcttctcctcatctggaaagttgggtcatgtgaacagggttgttaggacaattaaattatataattattcaaatattctttttaggctactgtgtgttttacaaatgaaaggtattgttaagatcaaacaaaacaaggtagactttttgcactcatctgaatgcttcaccctctgattcactgtaggcagcaccaatgccctattactttttaaagtggtttccattcatgtttaagtcactagtttccattccagcaataggtcagtgagttaggggcagctaaaaatataactgcctgaacgaaacaaagaatcctccatcttgacttttactctttgtttcctttttgttttagaaaaccacttgagttggccaacaagcacccaagtgtgatagaaggatggtgggtttcacatctcactcccatcaaccataaatgtgtagcatcacacaagctctctgagcctgcctgcaggtgagttacctcacagcaaaaatttaaataataacattcacactgcagtttcttctgaaaacccctgttacatagtaagggtgttcatcctgccttacaaaatatactgatgccaagtccaagatcagaaatgtgctcttaatctaaatttaggaagattaaacaaagttggtgagcatccagaaaggtcaaaataaaacttgagtttgcaatataatgataaccttggagtatttcagactgtcagctcccttaagtggcacacaggttgttgtttgattggtgtgatgtcagacaaacctggattcaagaccgggttcttctcctaccagctctgtgatcttggaaaagggactggatctctgaaactcaggttcctttcatgtgaaatagacccatatcaagtctctcctcaagctgtccatgtgaggattagatgaagcatctggctactgttattattgtggaggaacattagctcaagccacctgcagcagacagaccctaaagtgacccccagatccccttgccttctggcattcatgccttatatataatcccttcgagtgtgaatgggatctatggcttgtttctagctaacagaacatagtaaaggaaagattttctgcagatgttatcaaggcctaaatcagttgcttttgaattaagcaaaagagatgctatcctgggtggccttactgggtgaaagctgctagaaaagagattcttgctagtcctaaaaaagcaagctactatcatgtgaatttcctgtgaagagggccagttggcactgtaccataggcagcctctaggggctgagggcctcaatcctaaaactgcaagaaactgaattctaccaacacccaccagagcttggaagaagactcagaactacagacaaggatgcagtcctagctgacaccttgactgtagcctgtgagatacagagcagaggacccagctaagccattgtcagattcctgacacgtagaaactgtgagataagaaaggtatttgttttaaactgctaaatttgtggtaagttgttacacagcaaagcaaactaatatacccctatttctggaaatcatttcctagagacaggcttgtattggaggaagatggggtttcctcacgtcccatctacagaactgatgaatgtagggatgagggaaggaaaagaaagcttcctcagatacatctgggagtgggtatgtgtgagcagagggttgctatagtagaaagagaggttaatgagacagaatgtgaggagctcaacactgatacttgacagccttgtcaaacacagctattggttgaaactgtgtgaatccataacaagatttttaaaaaattagactttaattgttatgttgtggatttgtgcataccatctacttcctaaaagactttaggggcactcgaaatcaaaacaacttatgatcatagcaaaaataattaacaagaggaaagatgggcatcagaataaggttgataaagggcagcgatggaagagaaagttgtatcaagagttccagaggctgtgaggcaagccccttccccactctcaggccattctaacctaccatcttcaatggtatcaggtgctcacacctataaagcccacctctaaatctgactctgccttggggaccttgtcctgcattcctgcacatcctgtgggatacactgtgatgccccacacgtaggagatgctcagcagatgtctagtgaaatgaattgttgacccagctcatttctaacaggcagcctttccagagaatgacagcgaatgtgtactctctgtgtttgaagactgtgtgatgttaattgaagtgcctgcaagtcaaaataagaatgacagtttattttaaaaaaatattttaatggggatcctgaaagtgaaaacaaatccttcacggagagattctttattgaagagaattttagaaagaccacagaattcagtcctgccccactgtgaattcaattccctgggtaaactacatagcgtgtgtttatgcctaacagatacatatgcatcatatgcatgggtggcctgtatgtgaatgcagaaatacctgtgtatttacactccagtatatctgctgtaagtctgtatcagtgtttctccaccctattttcattatcacctccctcaaggacgctttgtaaacatgttttccctaatcaccccttatatagacttaataccacagatacactgtatatctatttaagggctgtatgtatatatttatgccttatataaaaagagtgtaattttgtaccccatatgaaccaattttattacttttggggtgataattacccccctgccttgagaatacatggtctatatgtgcatctgtgtgtgtgtgcatatgtgtgcctgtgtgtgcacacacacacagacacacaaacacaagctaactgggcagaggtctgaaaagcattttgagatatttgaggagaggtttcccatcaataaccaagaaagcagttctggtccagtgattcttgtaggaaacagatgctagcaattagaaaactggaaaactccagttggtcctgaagcacactgggcatgacctgttttccaaatcttcagagatgggggagattttataaggccatatgagcagaaaacatctaattgttcataagaggaaaatttctgaaattctaatgtctacattgccattgcaaactatgaagttctcacatctattttaaagtaactgagcaaaatacattttggacaaaagggaaccattagcatgtttaatattttataaatatgatcactatggtaggcaagactttattcaacaatcaatcaagctctgaaactctcatttgcacctcgaaatgcttagctttacaaaaagagttgtaggaaatgtggaagtaaagatcaatgcatctgctttcaaatatcttcaatccaattttgttacaacataaaccagataaatatctgaggacctcaaatctgtgtgagttacatcaaccacaggacatgggagagaaaacccctctcttgctactctgagtaactgtagcactacaaaaacacagcatcattcaatcacatttctaaccctgacaaactttcacataacagaggtactgaccactttcacctttcctttttaaataaaactgtaaactaaggagaaggtaaaaacaagggccactagagtgggaacagatttgctaacaactgtgattggttagtgtacacttactatgtgcccagtactatgtgttgggcccaaatacacgaattctttctatagcaagccctgcggaaatcattcagcctctgttaaaatacatccgttcatgggaagctcaccacctttctcaagataccccattgctctgttggggaagttttattttaagaaagttctttgatgtgttaagctaaagttggcttctccacttaaaatcttaaaatcagccctcagcttttttcttgagattgacataaataagttgaattatttctccatgtggttcactaaaggcagggctcatggtcagcagatatccccaccaagaccacatcttcagtgaaggctgaccagatgggaattcaacaggctgagggtaaggataacagttaactgtcttacatgttgttgctcaggtagtgaatgacatgagtattaaattgggcatttatttacccgttgatgatagactggataaagaaaatgtggtacatatacaccatggaatactatgcagtcataaaaatgaatgagatcatgtcttttgcagggacatggatgaagctggaagccattgtcctcagcaaactaacacgggaacagaaaaccaaacaccgcatgttctcactcataagtgggagttaaacaacgaaaacacatggacacagggaggggaacaacgcacaccagggcatgttgcagggtgaggggtgaggggagggaattcagaggatgggtcaatagttgcagcaaaccaccatggcacatgtatacctatggaacaaacctgcacgttctgcacgtgtatcccgggacttaaagtaaaaaataaaaataaaaataaaaaattgggcatgtattacccaacaccatgtctcatgagtggtgaaagaagcagataaatctgggcaagtaaaggaagtccactgtgtacagtgcccacggacctacagagacagagggtgcccagtgcctacacctttgacctccctccaaccactgctgaagcttccttgacacttcctatccttgacagttggttacaattatgtctgctcttgccctcacccattcactctctcaccagaaaataattaaagggaactaatatatttataaataacagtccttttcctttttaaattttcatataaacttgggaaatgtacagtgaacaagtactattggtatattctcaatattcaagcctattatagtgtccaggaaaagggatgggaagaaagaattaaagaaagaaatgttttttttaaaaaaaacctcaaggtggccaggaacactgttccttcaccccagataccaggcaggcccctttggccactccttaggagagatgataggttaggaacatgtataagctgtgtggccttgaacaagccacttaaccattagtgcctcagtttcctcatctatacaatcctaataatagtatttaatacatagagttgtggggattaaataataaattcacataaagctattagagcacacatagtaagcatttagtcaatgttagctgtcattactattattcttttcccttgaaggaggctttcagaaatttttataacttgatttcactcagtgagaagccttcaatttggtaacagaagaggggatggagagggaggagaaagaactcacagtgtgatctgctttacgcaggcctcccaaggctggcccagcaactcaagataattctgtgttcatacaagccctacctacaatactgggttgacatttctgttttctctattaaaagcatcccaaataatgtactgaagttgtaaaataaatctttggtgctaaatatcctaatgagacatttagaagcactcaaattaggtgttacaattaatatcataggatctataagattcaaaagaaaattccatttattttttttctaaagagataataatctgagactggataaagaaatgtggtacacatacaccatggaatactatgcagccataaaaaggaatgagaccatgtcctttgcggggacatggaagctcaaagccattatcctcagcaagctaacacagaaacagaagaccaaatgccatatgttctcacgtataagtgggagctgaataatgagaacacatggacacaggaagtggaacaacacacacacactggggactgttgagggctggggtggggggagagagagcattaggaaaaatagctaatgcatgctgggcttcatacccaggtaatgggttgataggtgcagcaaaccaccatggcacatgtttacctatgtaacaaacctgcacatcctgcacatgtacctcagaactaaaaaaaaaaaaaaaatagaaatgaaagaaataatgatctgggctcttttttgcaaaccacggaactcactctagctaaattaagcaaaagagaagtggggttagaaagccagttcttgatattagccctttgtcagatgagtaggttgcaaaaattttctcccattttgtaggttgcctgttcactctgatggtagtttcttttgctgtgcagaagctctttagtttaattagatcccatttgtcaattttgtcttttgttgccattgcttttggtgttttagacatgaagtccttgcccatgcctatgtcctgaatggtattgcctaggttttcttctagggtttttatggttttaggtctaaagtttaagtctttaatccatcttgaattgatttttgtataaggtgtagggaagggatccagtttcagctttctacatatggctagccagttttcccagcaccatttattaaatagggaatcctttccccattgcttgttttaatctacaatgaactcaaacaaatttacaggaaaaaaacaaacaaccccatcaaaaagtgggcgaaggatatgaacagacacttctcaaaagaagacatttatgcagccaaaagacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacattgttggtgggactgtaaactagttcaaccattgtggaagtcagtgtggtgattcctcagggatctagaactagaaataccatttgacccagccatcccattactgggtatatacccaaaagactataaatcatgctgctataaagacacatgcacacatatgtttattgcagcattattcacaatagcaaagacttggaaccaagccaaatgtccaacaatgatagactggattaagaaaatgtggcacatatacaccatggaatactatgcagccataaaaaatgatgagttcatgtcctttgtagggacatggatgaaactggaaatcatcattctcagtaaactctcgcaagaacaaaaaaccaaacaccgcatattctcactcataggtgggaattgaacaatgagatcacatggacacaggaaggggaacatcacactctggggactgttgtggggtggggggaggggggagggatagcattgggagatatacctaatgctagatgatgagttagtgggtgcagcgcaccagcatggcacatgtatacatatgtaactaacctacacaatgtgcacatgtaccctaaaacttaaagtataataataaaagaaaaaaaaaaaaaaagaaagccagttcttggcttctgccttgaagatgctgggcctaagaagcgtgttcaaatggcactgggtagcaatgaagtaggacgaatatctactacatacatcaataacaaaatcagttaaaaatactcccaaaatacaaacatatgaatagtgggcaaaagtgccctttattgttacttgttggcaaaagaaagaaccaatttcctgccagatcatggcatttgagactatggaaaaaggcctggaacatgaggaaattaggcatgcacacacacacaatgaaagtggctaatgtgaaagttaaccaaagtaagttaaccaaagccagagactataagtaggttccatgagtttatacaatctgaattaagcccaggacccagcaggcccaggaatgtggttccatctgtttcatggttgaaaaattccccagagaggccaagtgccttgatcaagggtgtaggggagtcaagagcagaaactgccctgagtgtttaccattaggaatgtgtgacctcataagacagtattctcctttctcaggtaatctgtccttgggagcggttgtctggggcttcacagaatggctttcctgcttgaatggcttggctaactcacctggtatgcaaaattggtttggaaatgagctaatcattatatttttcacacggtgacatcctggaaagacctgctgtgagttcccactagggaagtggaaacttcctagctaccttctcataggcaggtggctatgtcccagcacacagatgttaggacactgctcagaggagcagcatgtgtcagcagcacatggcttggcaggagccaggagtctaagcagtaaatatcaagggaatgatttgtcagaatagcaccccaagtgcaggggaagtgagaggaggcgtagtggtagaattagggaatgagttctgtctacatccagggcttccacctgaggactcgagtccgcaaccacaaaaacctttctatggacctggcaacaaagtcctaagcttcagcccctgtgaatatttcaacacatgcaggataggaatattaataacctggattcacatcagaatgttctccaagtaattcagaatgcttcattttacagctcaaccctgaggttgccagatctcagtgcttcatggaatggacagtgacaggtgaatatggccactctcactgaaggcagctcctccaacctcataaccatttacagcaaaggccaagcccacagctccaggcatcatgccacattcgttcaattccttcttggaagggtacctaggtcagcgatcagctcacacctgtttttgtagatgaggtgttactagaacacaggtatgtccatttgtttacatgttgtctacagctgcttttatactacaaaggcataactgggtagctgcaacagagactgtatagcctttaaggtctaagacattcaccctgtgactctttacagaggacatttgctgacctcaacctaggctatgagagctccaaggccattcaccaagtatattgtaaactccctgagagcagagtccttttggaacctcccatgggacctcacacagtgaggtacacaagagaatcaaagaatcaacttttagagctgaaagggacctcgggtatcattttatccaacccttttattttagagatgaagaaacccaagctgccagttgaaaataacagaatggcagaaagcagaaccaaaaatcaagtttcctaaactccactgtaatgctctattacttgacaattggtgaatataaaataaatgaaaagataggtatggatttacacaggaatatcatttgctgggtatatggtgtgtgccaaatactatgtggatgtgggtatttcagttttggacctcaaatctcaggagaaaagtgtatgtatacatattatatatacacataaaatttatatgtgtatcctgtatattatgtgtgtgtatacagttgacccttgcaaaacacaagtttgaactgcacagatccacttatacatggataagtataagtgggtcttccacctctgtcactcccgagagaataaggccaacccctcctcttcctcctcctcttcctcctcagcctactcaatgtgaagatgaggaggatgaagacttatgatgacccactcccacttaatgaatagtaaatctattttctcttccttgtggttttttttttttttttttttttttgagacggagtctcgctctgtcgcccaggcaggactgcggactgcagtggcgcaatctcggctcactgcaagctccgcttcccgggttcacgccattctcctgcctcagcctcccgagtagctgggactacaggcgcccgccaccgcgcccggctaatttttttttttgtatttttagtagagacggggtttcaccttgttagccaggatggtctcgatctcctgacctcatgatccacccgcctcggcctcccaaagtgctgggattacaggcgtgagccaccgcgcccggccttccttgtggttttttaaataacattttctgttatctccttactgtattgtaataataccatatataatgcatatagcctacaaaatgtgtgttgactgttatgttatcagtaaggcttcccatcagtagtaggctattagtagttaagattttaggaagtcaaaagttacacatggattttcaacttgtatggaggggtcagtgcccctaacctccacgttgtttggaggttaactgtatatatgtaaaacacacacatactgtgtatgtctgtgtaataataagatgatggtgcacatgctcctttgaaggagacacccaccgtgaggggagtatccatctgatttgtgacttcagggtcaccatttttagttgttaccacctgttcatctgaacccaggtgatggaagtcagcaccaaaccgaaggagcagagccatgcatggatggtctttgtctttcatccctggtgtattggtttgttttcatgctgctatgaagaaatacccaagactgggtaatttataaagaaaagaggtttaattgactcacggttccgcagggctggggagacctcaggaaacttacaatcatggtagaatgcacctcttcacagggcagcaggagagagaatgactgccagcaggggaaatgccagacacttatgaaaccatcagactcgtagactcactcactatcacgagaacagcatgggggaaacaacccccaagattcaattacctcccatcgggtctctcccttgacacatggggattattacaattcaaggtgagatttgggtggggatgcagagccaaaccatatcacagagcctctttttccagctcttcattgaccatcccccatgtcacaaacctcttgtcaactaggtgcatctgataaccactctttgaaatgaagtctgggtattccttcactctacagtgttcaccaacaaggcattccctttgagaggcatttttctcccactctggaatgaaagttgcctcgccctagttagagcaattcttggcatacagatggaaaatgctttctgaggagtgttaggcctagataagcctcttatcatcctttagggtgaccttaactgggagaggaaccagaagagatagtccatggtttttctccagcagtgtccttactctcctggggtaggtgggtaccaagagaaggtcctggggtcttgactgggtggagagcctggtgtccccctatcacctgctctggaatctgccctagcaacaggtctacgggggagagaggggaagaggtggatggctttctcccccttctctgcctgagcttagctgggcctctcccctcatgttgcacacttgaactgaaccccaacttcttccctggctgtgctgcaaaacactgcttagtgccttcctgataccaggtcccttggcttggagctcccatagcctcattcttgccttcaggccacagtccttccaaatgcccagtggctgccactctcccagacccccaggctgcaagttctgccaggtcccagctggcttcccccacaagacccagggcctggcacctggtaggcttcagtaaacagctgccacatggaaaagtgcatttcaagtaccttgacttcattttttattgtttttaattatgaacacacattaaagggttttggagttagtcagaaaccccaactctgccactttccatgggaccttgagcaaaacacctaacctttctgaagccagatttcgcatgtaaaacaatcacaatatatctaaaggagtagggatactggattaaacagagtgtcaccacaatatctggtgcataggagagagatgctctgcaaattatatttattataatgccttccctgatcctgctacccttgaccatggcaagtgtctcagaaagactcagaaagtcctagcagtgaggctggaccacccccaccccccacaccagggagtaaactcaatcagcagcagctttattctcacctctgctttcagtcttctatgtggcattataacagcctaacttgtctgggcctcaaggaggaatgaagctgctagaatcctgcgaggactcgatggaatccatcaaattccatggacgatattgtaaatttctttagatttattgttatatctcacatttatagtgcctagtgaatagtctgtaattttttttgttgttgttgttgttggactctgccatacatatctgtaaatgactctaggtcttagaatggaagaagagccgactggaatagatgtaagatttctctcaagtcagtggcttcatccttgcaaagatgattttcagagcttactctagaatcctgactgaggaacttgggccaatgccacatcttgggcaaactggccaggggacaaaatctgctcttggtggccacacccacaatgcacaacaggtacacttttttttcccagtggcatgcaatactcctggtctctcttacccacttccttctggtcctcttccctctgcctactgacctgataaagtaatcccagataatgtgtcagctggggctactgcatccataggtagcccattacaagtagcatatgtatatttttaaaaggacgtctaagaaacattccttaagccaaaggggttgatcaaagaatgggagttcatgtcactatggcagagaagtgggtaggagacttgagaacaggtgcgtctttaggctgctctaactcacccaatctggtaattgccctgctttcttgtctaagtgttgggatctgaccttgaccttggactattcattgccacctatggagaattaaggaaaggcaaaaccttggtcatctccctcttgctcgccattgggaaaatgccttctgatttagcgcagcaatttctcctcattaagctacaaggggctgggtaaaatgaggcaggagagagcacaaattctgatgtcaggggatgaagtttgaagccaggctctacaatgtcctagctttgtgcatttatccagatgggactcagtctgaccttcagtttcctcatctgtaaattgggaatagtaccaagacctactccatggaattcaaggaatcagcgaaactaaggtgttcagaatagcagttagccactgttgctattattcaatttccaaactgattctctgattttgaaaatgcaaagacaccactcatgggaccaaagaggactgaggtgtgaagactggtttttctgtatcataagccacttcagtgatcctctgtctcacctacccttttccctcttccatccccgctatctctttcccaacattttcctcttcaagaaccttatactttgaggatggggataaatacctttgcaaaaacaacaacaacaccaacaacaaaacaataaacaaggctgcaactgtttttataattccacgggccatggagcagatcctaagtctaaaggtcactatataaaatgactgagatgttatataccttggggtgacctgagagcagtagaagaccactcgcctaccaaatctctcctacatttgaatgtcacagggctttaaatttccactgttagactcacccctgtgggttttggatactcccatggggcctggttaggttaagggcagtgttcccttaaccagactgggcacaagaatcacctgcagcacttgttaaattacaggtatctgggacctccttccctgaagactctgattcacacatttgggctggagtttggaaaatgccccaggtggttctcatgcctgtgcaaggctgggaaaccctgttctggtggagagtggtcaggtctggagtccggatctccaggtttctaagtttgtatagagcaacccatcatgcagcccctgacaaatcacctggtatatgagaggattaactatcttccttcctcaaaggataagagacccaaaaatgcttcaaaaaactgtatgtacacacaaggaaccattttaacagaatatgggaaataacgctgggaaaaggaatgcaagaatagtttcagtatcaggtggaagcagttgaagttgatctagcagatggggaatcgatgtcatacaggagaaggttcttctttaggaagattaagtggacagtattaagcatggtcaacaggaggtgagagaggctgcaggtgggatgccagtttgtagtaggaaacaagaatacataacttagtttctacggtagagactagctccaaacctgcttcctctctgtccttgcagcacagttagatgacacttcccagcttcccttgcacagaggaacagccacaggattgagctctggactatggaaagtgggtggaagtgattcgaccatgcaaacctaccatgatgtcctccaacttcaatcttccctgtgctggctgactgtagagagcccagcaaaggagttggccgtcccgcagggtggcagaactacagggtggagggagtccaagtgggggagaccactcactaaacactgcattgagctactgtgtgaaaaagttggtaggttgttgtttcagcagttgacctataccgaccaaggcagtgcctgacatctgaacagtgaagactgtagtttgcaaaaggggttcatgtttcttatcttatttgacttcataataataatcctgccacacagatcagatccctgttatattcacaaagtacctgaatgaggaaaggccacataactttccctacacagctcccctctcccagagcctgtggggaagccctgcccagaaccttcaattccacaagtaaaacctgagtcatttgtgacaaagggccaaggacatatggctcctttggtttcaggggcaaattctaaagacactgctgtctctagattttatgctataactataaaatgccacagagagcaaatgtgtaaatgaataaaaggcaggtgagacggcccctcgtcttcatccttggtgttgacggggcccatgcacactggcagcattaggaagcagacgtggacattgacaggagaggagccttgggctggatcaagaaacctctatctgttgccatgacaatctcccaaattggatgtttaagagaataactgggacatggtgttacttcgtctctattctaggtaatgggttcccagttggactccattcactgcacatcctcccctccttccccttttgtgttatttctccagtcggacacttgtttcttttccctcttaccatagaataacgttaaacaaaagtggaaaagaaaccatcaccctgaagtccatagaggttgatataggatatggggtaactggcacaaaacttctacacaccaaagcctgtgggtaaccagagacgtgctgcaaaggcctcccacgccaaaacaccctgcctcagatgcagggccaaatgcaccatgtttagataattaagcacttccctcttttaaactacaattgctccacaggcaggtaggggcacagcagtcttccactttataaacaaaagtctggatcccccagcttgccatcagagatgcttcatgatctgatctgctagatctgaatgtttgtgtccccccagaattcctatgctaaaatttcatctctgaggtgttggcattagcaggtggaggctttgggaggtgattaggtcatgagggtggagccctcacaaatgggattagtgttctcatgaggggctgaagagaatagagttatcctcctccacaatgtgagaacccagtgagaaggtgacagctatgaaccacattgtggccctcaccagacaccaaatctattggtgcactgatagactccccagcctccagaactgtgagaaataaatttctgttgtttataagctacctagttcatggcattttgtcatagcagctcaaagagattaggacagagcctatgtgtgtatatatatatatatatatttatatatatatatatacacacatgtataaatatatatacatgtataaatatatatatacatgtataaatatatatatacacatgtataaatacatatatatatatatatatacacatgtataaatacatatatatatatatatatatatatatatatatatttagatggaatcttgccctatcgcccagcctggagtgcaatggcgcaatcttggcccactgcagcctccgcctccttggttcaagcaattctcctgcctcaacttcctgagtagctgggattacaggcatgcgccaccatgtccagctaattttttgtatctttagtagagacggggtttcaccatattggccaggctggtctcgaactcttgacctcatgatctgcccacctcagcctcccaaagtgctgggattacagatgtgagccactgcgcctggcccctaacttacatttttatctgccttcccaatatccattcacaccctcttcagcacagccaagcagagctctgagttttctgggacacatccgggcttgtcttgcttctgagccattgttcacatgatttcctttgcctaggacattgcatttatttcctacctcttattccttgatcaccttggctaactcctcacgtgcctcattcctccctctcaaatgatatttcttttttttcctttttttttttttttgagacagtcttgctctgtcaccaggctggagtacagtggtgcaaactcagccctctgcaacatccacctcccgggttcaagcgattcccctgcctcagtctcctaagtagctggggctataggtgggtgccaccacacccggctaatttttttgtattttgctagagacggcgtttcaccatgttggccaggatggtctcgatcccctgacatgatccccctgcctcggcctcccaaagtgctgagattacagtcatgagccaccatgcccagccccaaaagacattttttaaagcaagtccttatttctgtacttcttctccatgctccctcctctggggaacctcctccgtcacctgtagctctgagcagaagttcagataaaatccctagccctgagcccctgtgatcctcagctctgatccttcagcattctaaggaacatctgcacaggactggcctgccagcacttcagattacaccattccaaatcaaacgattttaatgaacagcaactcccttcctcacaggatacataggctttcttcagagttaaaaggaaacttaaagctcaattagtttgtctgtactcttcaatttacaatatcttagacagtaatggtcaagcccatcaaagatatcaccattctagatgtggacactaacctttccaggggtgaatgtaccaggaaactgctgagtcttcggtgttggtgcccctaatatacactatttgcacaggcttcttccaaggcatgcacctaattttgtattcacttctgtattccacaacacactctgtcttttggcccttgtttggactcacttggcctcctgatgggaccactgggatagcctcctcactgacttctgcctcagggctctccttattccaacatggtcacagtgaatgcagccgtaatagcaatggcaaaaacagcagcagctcacattttatctcactactcttccttaaacccacatagcgtatatcccaaagtgttagattgggaacttatctcatcagagaaggtcagactggatgacttctggaagcttttccaaataataaattctatggttttatgaatgttgatcacattttatagaaaaaaaaaacttacccttaaagcaagtcacgcaaccagtgcgtggcagacctggaatccagatcttctttcttttgtttgtttgttttttcctgttttttttctttttctttttttttttttcccgattttcatttgcacaaatttatggggtacatgagcaattttgttacatgcatagattgtgcagtgatcaagtcaggacttttagggtatccatcatactttgagttcattgattttcccactaaagcacgaagtccagctatcaatctttctaaacataacccaagtcaatctcctattgtgtgtagacacttccagttactccccactacttacaagggagcagataccacttacctcccattcaaggccccctcctgccactgttgttggcttttttgctgtcctatttccaattgctcctttcatataccacttgcttcagacaaccccgtgtactcataagccctgagcatccccatctccacacctttgctggacctgacatggttgctcacttttggccacctctgaatcctgatcattcttcaagactcaactcaggtcccaccctacccaaagctgggcctgaagacaccatttgggccacactggtcccatcatatgcatgactcattgcattcctgtcactcatgtgccactgatgcttgtttgcattgcactcctcagtggcactctcacaagctactggagcctgtcttcttctctgatctcccccagcccccttcagctttcacagagcctggcacagagtaggtgctctgtaagcattttcatatattgattgattgattatattttatccccaactccctacattctttatcttactatctccttcatgcattgccatttaaaattatgtgtcactcctatataataaaaaatatacaaaggaagaaaagaaaaattacaaaagaaaggtcaaaagcatttctttcctcccttttctggtttatttgaggtcaatctggagtgattcatgtgaaccagcatattgccttggctacctccatcctgtgaaatgcttgtttgaagtagcgactggaccatattttgtccttttgatgctccactgagtagttcagccctatttacccatggtttgcaccagtggttctcagtctttgatgggcttcagaatcaccagtgggtagcttcttaagcatacagatgcctgggcctcaccccaccctcctaaatctgaaactctatagacaggacctgggcaggtacaagtgaagaaggcaagtgcagtgactctttcatgccccaaaggctgagaaccaccagcctacccatggtttacctccagtgctgctggcatgggaagagtctttgaatcccccttaaagactcttcccatgccagcagagctaaaagaacttctagaagttaacaactccatttctttttacagggaagaattcgtttcagttcagacagtaggctatttatcttatttgtccttaaagaatttcacatctcagaacttagatacttctttcttgaaagaaaagacacgtttccaaagcaggttgtcatttagcgaactggaagagaaatgtccctgactgtgggagctgacccctcagaacacaagcagtgttagatttaagacaccctgggtagagagagtcctttacagaactacatcttaggaaactcatgcttaaccactttgcatctttactatctctagttcctccagtcttgacaacagatacaactcaggatgtgttctgggtaatagttttttaatagataccagagagtgagagcctacgacattttccccataatcctggtagataatacgtgtgcatgtgtgagtatatttgatgagagcacctatggctatgcatagctggaagattgttgaggaaggggtagtaaaatctgcaaagagaaccagggatcctcttgaaaataaagaggatcctttaccctggcctggctaccaggagccttggggaagcagttatgtaggagctttcttggatgagggagcaactgacaggaggaatcaacttcccctgagtttgaagaacccagtgggtcagggatctgcagttaccctgtagtcagtccaaccacattactccagacatgggctctagtgggctccagcttatggagcagcagtccagtcagaggcagtcagatccagtggtggttgcactgtacttcagttgccattggtctgcagcaatgagactcactgcttgtgttctcaggggtcagctccaacaatcgggaacatttctcttccagttccctgaatgacgacctgctttggaaacttacattttctttcaagaagtatcttggttctgagatgtgagattcagctggtaggactgagcctctgacttcttgtacacatcaagggagggaagcccaagggctttacttttacttattgggctacatggagcctacagagaaagacttactaataggccagatccatactcagcttgaaatgctgacaccaactccatgaaagatgtgctgctgctattagcactgcactggttaaaacaaaaaaaaaatctgtggtccagagaggtcaagcagcccatcctggccaacacactggtgaacccgagcctgacaccaaagtttcactcttccaccacatctcttgccaccactaacatggggccagcagctgacaactcaaagggaaccaagaatgagaagtttttgacctaactgactgtctaaattgacagacgctttgtcttgcatggagggggccaataaatgcccaaagagacaacacaagtcatcagggatgcaggagctctcaacactggcagtggacgtcagcttctgcagacccagtcctcattcccaccaccctgccatggcacttcaaatatgcatcatacaactcttgacgctagctctccagggatgtgttaccaggagaagaagcactcactgccatagcagggcaggcaaatttgtgtattgcgttattgactacagatcaaaacctgaagatagtgggaaagaaaaacacagtagcttaatatgatgaagggaactttaaaaacctagtgagctcatgcttaggcaagcggcccaaggtgaccaggcagtcacagtagctcagggacatagaggcgacaccacaagatctgatcctatctgttctggaagtcagatgaccacaccacgagtcaccacaacttgtattgcaccctgcaccactcagaaacttttgggccactcaataaatgaaagactagtcgtttccatcagacaattagcagaactctgttttacttcccccatgctgaattgatgattctttgactagaccaaccctatacacgattgttctggagtcctgtggatagggcttaatagttcgtcagcatctgttaactgggcagtgattggatgcaagctttctatcaacaacacttctgaccgtgatgccctgaggctgttagaagttctggacatttaatcagcattagcaaggccacctatgtcagcggtggcagaagctgcctgctattggacctgcctctgattatgactcagtggctctccaccagggctgcacgctggagccacctgagagtggatatgaaaatattgtttcagggtcccacccacagacacactgatgtaatcggcttggggagcaaactgccatcagaagttttaaaatctctctcaatggattgaataggtagtgaaggctgagaaccactggtttctgttgaaacctcagttcctggctgaagagacacttgcggcgagcttgtctgtatcattagtcacttctggggtccaggggtgagactgggagtggaggaagcaatgcaaatgggtggaatgccttgatctaacctacacagcacatcctgtgtttgtcttttcaaattgctttctgttttgcttttacttccttgctctatttctttcaataaaccacactcactgccattacctctagcctgttgtcctcctcttaggatcaaagtccaagctacatattatctcatttactctcaaaatatccctgcaagtgaggaaggagccaggcctttgttccccaaggcaaatcagggacgtgcaggtccagaaaggttcagtctgccatgggactcataatattcaagtcagtgtgtttacagcaattttcaatttacaaagtgttttcacctatgttctcccatggaatcctcacagcaaatctacaatgacagtattttcataaccagaatgaccacacatccttatttgctcccaaactatcctgggttatacctgtggttccagcctaattattgatatcattccctttcactctcaaaagtgtctagatttggacaataaattatatggtctccttatttataaccatgctcttgttttaagagggccagtgaggctcctgaaagttaaataatttgttcaggatcatttagctaattagaggcagaggcaagacttgaactcaggtactgcatctccaaatccctgcgccatccacaggtattatgggacattagaatcagagttgacatgatctaacatttcttattgtagaaactaaaaatgtggggaaataatctcttaaaagtcactgtcagaatgttccccgaaagggaaagactcggagtacatagcagaaatgggttagtctccttggaagcattctatgaacacattagaatggattaataacataaataaatgtcaccatgatggcacttgaaagcctaacttggcaaaataaggtatcaggcctgacatataggtatttggaaaagagcaagaaattcaaagtctaaactgctagatttgaggactggatctgaatgctatctgccatctacctttgggcattttacctactttctgtgagcacatgtattgttcaacagaacaggaggaattatcattcttagttccctgggctgttacaagaagagcaaactgcagctcatcaagtgctctgacagcgagtctcataaggtacctgtgaatccagtttatttgttttctttatctttcacataagtgaatcaagccttataaagttgctgatgatcaaatgagataaggtatttgaacatacttattatgtcctaatatgctgcaatctttccttcttcttatcattatcattatcagcagtagtagtaacagataatgactatcaattgacgtgggagacaattacaattacatgtcattgtgaaactcattaggtgactgtgatttagagtggtacacccagtggaaacaagaggttgggaggtccttccaagggggtgttgaaaatgaccaagtcatgactataactgggtgggacccatccttcttggaagtcttcatagaaaccaacccaccctgccctgcagaaagagcttcagttacctgacaccatcaacaagaaggcctttctttttatggggaatcatgtacctcagagaaactccaaactttggaaaagtgtgattctgtcaacaaggatattgcttccctcaaatgacacagttcaagtaaggcctgggcagcatctttatttcacaatatttctagcctttacttgtcccatttacttgtaaatgagaactgctaacctgaagctcaaaaagatggggttgagggaggagtcaaaacaactttcatacctgatgttttgatctccccatcaatctggtttttgagctagccatgaaggcctgcctggctctcattgatttcctttagggaaaaaacaaatgacaacacagtcattttagaattatttggggaacgctgcaaattgtgcagtaaggtttttatataaatggagagactctccaacactgccaacaagaaaattccaaaggtgcaggtagaatcggtctccacacctaggagtggggcaaagggctcctttggttctaaagaacctatttgtgtttcaaatatctttcagaaacttgacaccttgaaactaccactctcaaggaatctgagtaagtcctagaatcgctttcttcaaggagagcagcaagactcatcgctttgttaaagctctccctattcacccctagggcccaggcctggatgctggggttcagaacacccccttgctgccctaaggtccaacactacccagcatcagacgagaaatgacctcctttattacctgggtctgccaaaggacctggaaatccagcctggggtgggggtggggggagtcccagaaaccaaaggagcacacaggggccacagtgggaagagaacaggctgaagaaagcaagtgtcactaaatgtcaggtgtaagcttgaaaaataaacacaaagaatgtaaaacccagcagaagaaatttaacaaacctttgtggtaggctgggacaacggagacagatcacgtaccaagtgtaaagtaagtcacattttaagagtcagaaagtaccaaagaccacagattgttatcaaggtttatgtagatctcatactttttgcaaacatctatttaattagcttgtagagaaggatcttttgggcaaaataacattttcccaattccagggaatatttatgccttttaaattctgccaggaggcccctgacaggcaccagtgactcttcccttctcagcgatctgcatatttctagggaaactttgcactgagagagttttccccctttgtgaaaggtcttggcgcccaggcagtccccgacttcccctcccccaagtcctggcgactgtttctgctcagccctggaggctactctcccgcagcctcaggtttccctacttctgcagcgtcggcaccaagggctgatcaaatgtttctttctccttacaccggcggaccgggaaacgccgccgcagcctcgcctccatccttcctcctacaggttgcaaataaagtacagcagctctgacattaggcagtttctgtccaaggagcaaggtgacttcatttaatttgcactgtgctccttcatccctgtctgcatcaggttgaacgggaggctctccctactaccaaacgcctaacatttccttgatactgccttgaaaaatcatgattatgacaaaaataataacgtcggagaatggagtgcttgttttctgctttgcaagtcaccaagcaagaaaacacttttgtctccttggcttttattttaggatctctgagcgaaagagagaaagagaattttaagaaatgtcattttcgctttgccaaagatcattgtgtcaataacgtttctctcccattcctccccctcctcccgttttaaaggaaaggttcacgggtccagccaggtttctgccgcatcccgacacctggagacgtctttcaggaccagcctgaatcgcgtccgggctgggctctggactcggactcgcagcggtgacagcggaggcggggacgggggtggacaaactgcggatcaactctccgagaagacggccacctgccggaacctgccttcctccattccgcccaggagcctcgcagcggggcgctggcctgcggaaaggccacgggggagcacagggctccgcgccgccctcctgggagggtccggagtccagcgcaccccgagccctggtgggtgagcccggcgggaggcgcggcaggtgcggcgggagactggaccccgacctaccttcacaaagagctcgatctcggggtccctgtcgtccccgttagctgtcgccgagtctgtcatgccgttggcgcccggggctaccgtcccgggccggggaggcgccacctctgcagcacctgggccagcactctgcgctcctgccgctgcccagcggggctcctcttcagggcggtgtttaatttttcacaaaaccatctattctccagcccgagcagcggggtctgagagatcagtgtcccagatgctcacatgaaaaggagcgaagccgggaggaggcggggggccacggggaaagccgggttaagggaatgacaacaggtcgtgggagcaacaagtgccgggctgcccggaggtgtcacaggatccgcgactgtcagcgatcccgccgccgccaacgcgcccaaaatagccggcggctgcagggcggggtcagccgggcggggacgcggcggggacaccccggcagctcgggcctgggccgggccacggccccccgccccaagaccccgcagggcaggaggcggagacagagctggtcctggcaaagccaccaaggccaagaggatgtcctgggggcggataatgaggcgaaggcagaaagagtcgaggagaaggggaaggggaagaggaaggggaaaggggaaggggaagaggaaggggaaaggggaaggggaagaggaaggggaaaggggaaggggaagaggaaggggaaaggggaaggggaagaggaaggggaaaggggaaggggaaggaagagaggagatggctctcaagtcttctgtttctttaataaagcgtcagctcctccgagttactccactaccagccttacccacttggaaagcccttcctgtcttagtgatgctcagaacccccaccaaaaggggcatttgccatccttgggctaagcaaaaggagagtagggtgctggggacgggcagggcagggcaggggtggctcctggggcagaggggtgagtcaacccggtcaggtgcggcttccatgcctttcagccttctgggtttgtttatttttcttctcccttctttcattttctttctatttcttcctttattttctgatcttacttcattcccgttctcttctggttgttttagtgaagtaggatgcaaacacagaaaagatgcacatatcttaggtgtatgcctcaatgaattttcacaatccaacccacccatgtaacgagcgccagatgaagaataaaatgttagccacagccctagaagctcctcctgctctctcctctccacatcttttctcccgtctccactgtcccagggtaaccattattctggcttgtagcagcataggatctttttgcctggaatgttggtgtctggcttctttcgctcattactatgtttgtgagattcatccattgtgctatgtgtagttgtgtatcatccattttcaccgacacacttacttattcattcttctgtcaatggacatttgtgcaggtgactatcatgactactctgtcacgaacattctctctatcaaacatcttttggttggattcacagacacttttctcttggatgtatacttaggagtggacttgctgagttgtagtgtataagaatgctctccttgtgtaaacactgccataggttttctaaagtggttgcaccaacagacattcccacccttcagttctttaaaaaataattattgaatgttttgcaccagaatctggtggaattctctttgtcttctttgccttctctttaattaatcctgtttgtgctatgtccttccttactaaaaacatgtatttgtttaatagctttattaaaaaatttatcgcttaataaaaaaataagtaataatacttattatgtgctaggcaaaaatgttgagcactttacatgtgtgaacttgtataatatttacaaatagtataatgatcccaattttacaagtggggaaactgagacatgaagtatttaagtaacttatccctagtcattcagctaggaaatggtgaagtcaggatttaaacccagacagacttgagcctgtcctctcaactgctctacaaactgcttttcttagtgcacactatggaagtgcacactttgaggaaacaaaggcatggttttaacggtcttaacagagatcaaaatccctttcagaataatagttacatgaaatgaaaactaaggctgccacatgaattgggaagatgaaggagctatacaagctgtcacgtaaagatactatttaccatggttggggtgaggagaggaaaaggcttcatggagcaaaaggcactttagctgaaccttcctgaaaggtcaggcatctgataggcaaagaaaagggaaagatgtcctcactaccctttatggcaggctgtgtccccacagactctcagtgcaaattcctccttcctgaagaaagcagtcaccaagcccaacgtgcaactctcttggtacattataacttaatcaaggtgatgtttaattgctttcctcctgcttggcttcaggcttacatcaccaaagcctttagagaaacagtcaccttcacagctgtacattctgcaccaatgactacatactttagggaaggaccaaggttacagagggagactggtgccttcgctgcatgatgcacagactcagaacatccctgcactgaagtgtaggcaatattcttaatggcaatgtggcagtagcaaataaaattatatgcataaaatgtcttcgagggttttggttttttgttttttgttttaatgaaaaatgtgttacacgtattttcgatcatttccttggctatgatctaaacaatgtgtggtatgacttctctttccttaatcccaaacctatcagagttaactttcattttatcttctccaaatatctactgctattgtaaatttggacagatctctttcaataacattttataggaaatatctcccatttggacatccctgcagataacttatagttttgatattataaagcttcatgctgcaaaaaaaataattcttctttggtcataaactatttctgtgcatattttccattttcaatttcatattatgccttagctcaagataaaaggactttactttgtaccctttaatgttaaagaataattggttagagtcaattctagctttgtctggagaaaaacactatatgtctaattccagcccatagtttcacaaatgtggtgcaagttttgaataaatttttaccaggaaagtactttaaaaacacatttagtgctcactttggcagcacatattctaaaatggaaaccatacagagaagattggcatggctccaatgaaagggtgacatgcaaatctgtgtgacattcatatttttgtatgactgttgaaagtgaaaactataacatatctgatagcatttttaatatatttagattcaataatatgaccactgcagcataaagggtaaagggcaaggaatttatacagttgtaaggtttatatactttacttgatatagtaaactctaagtagcctgagaaaaactaggtatgtgtattgtaatccctaaagaaacagctatttgagttataaaacaaaagtatagtaaaaaaaaaaaagccaacagataagctaaaatggaatgacaagaaatattcaaataatctaaaaggcagaaaagaggaagagaatagaaaactgataataaaatggtacacctaaatataaccatattaatacttaagctaaatataaatggtctaagcacataaattaaaagctgaagattgttggattgcataaaaaagcaacaagaagacccaactatatgctgttacagaattcacttcaaacacaatgttattgataaattaaaagtaagaggatggaaaagcccctgccatgcaaacactaatcaaaagaaagctgggccgggcgcggtggctcacgcctgtaatcccagcactttgggaggccgaggcggatggatcatgaggtcaggagatcgagaccatcctggctaacaaggtgaaaccccgtctctactaaaaatacaaaaaattagccgggcgcggtggcgggcgcctgtagtcccagctactggggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaagaaagctaacctctaaattaatataattattaataatatataaacatatattaatgtaagtctattagacaaaatagacttcagaaaaaggaaattatcaggaatagagacattacataataataataataataacagagccagctcaccaagaagatagaacaaccttaaatgcatatatacttaataacagagcttcaatattgatgaaacaatagctgatggaactgaaaggagaaagagaaatacagaattatagttagagacttcagttctcctcttttggtaatttatagcacaagtagacaaaaaatccataagaatatagaatatagaagacctaaacaacactatcaataaccttgaccttatgaacatttgtggaatatcccacccaaacaacaacataatatacactattgtcagatatatatggaacatttaccaaaagagatcacattctgggtcacagaacaaacttcattacgttaaaataatgaaattatacaaagtatgttctctgaccataatggaatcaattaaattaatatccagaaagatatccaaaacacttccagttatttggaaattaagcaacacactttaagaaattcattgatcaacaaggaagcctcaaggattattaaaaaatattttgaactgaattcaaatgaacatacaacatatcaaaatttgtgagatgcagctaaagcaacgcttagtagaaatttatacataaaacacttattttggaaaataataaagttctgaaatttataatctaggcttccattttatggaactagaaaaaagaacagccagctaaaaccaaagcaagcaaaaataataaaataataaatataaaaacagaaattaatgaaatcgaagaaaaaataaaacaatagagaaaatcaataatactagaggctggtttttatcaaagatcaataaagttgataaatttctcactagatttaccaaaaaactagagagagaagatatattatcaatgttagatacaaaagatgggatatcaactatgaacttcacagatacaaaaagataagggagtactacaaacaactctctgaacataaattagaccatttagataaaatggataaaagacacagactaacaaaattcactcaatgagaagtagataacctgaatagtcctatatttattaaacatattaaattcatagttgaaagccctccaagaaaagaaaactacagccccatataccttcattaatgaattctactaaacattttagaaagaataacaccaattccatgcaatctcttccagtaatgagaagaggaggaagtgaaggacttgtatccaggatttgtaaagaatttttacaactcaaaaaaaaaaaaaaaaaaaaacccagctaaaaaaataggcaaaatatctgagcagacactttaacctagaagacttaccaatggcaaacacatgaaaatatgctcaacgttcttcagtagagcaatgcaaataaagagataccacaatatacctattagaatggttacaatgtgcattcatgataatcccatgtgtgagcaagaatacagagcaactggaactctcatacattgatggtaggaatgcaaaattgtacagtcattctggacagcagtttggcattttcatataaagtcaaatgtacacttactatatggcccacttaccatcttctgggtattatccaagagaaatgaaaacttatgtttacataaaaccttggtacataaatttttttttacaaaagtattattcataattgccccaaactggaaacatccccaaatgttcctcaatgggtaaatgaattaaaaaaagtgataacatttatgcaacggtatatcacttagcgataaaaagaatgagctattaattggtgcacaacacaggtaaatctcaaatgccccatattaagtgaaaaagaaaagcagtctcaaaaggttacttactgtatggtttcatttacatgacattctggaaaataaaaaaattatagggatggagagaagatcagtggctgccagggactgggatagatgagggcttgattacaaaggggcagctttcagctgatagaactactttgcatcctgtttgtgtcattggttacacacatttctgtatgtgttaaaatatacagaactacacaccaaaaaggtgaattttctgtatgcaaatttaaaaaatgatcaaaatgcttaaataatttccaaaaaggtaaagccatcaggttctattgccatacccactttccacacagtctttgcttcaaatctgtaacatcagacctcatcttaccattaatttcagaaatgtaaaagagatttctattttatgagatgcagtgcttctaattaggctgatcaacaaaataaaacaaactttcattgaaataacaaaacaaaataaacatatttagacagtgtgtttgtgtgtgtgtgttatgaaatgacatgtactgtaaaataatgatgatgcttatggggagatttttcagaaaatgcttgccctacccactaccggagtgcaatcacattattagtcacaagttccagcttttatgtacctagcagtactcagttgagcccactcactatacccagagtagcagctatttccatgggaattaaacaacttacattctctgcaggagatctcccagacaatctcaaggacttgaggtttaagctggaagattttgatgacagcttcagaaagacattatgcccttgtgggaggaccaactgggtgtagacgaagggaggtgaatcctagagggatcacacctgcatgaggtcacagattgggctatgagggggattgaggtgagttgttagttctatttctttataacctaaggtgtccttgggcatggccaacatgatcaatgatcttggctctcactgcagtctgtctattggtgcttagcaaaggcagaggcctgggagtgagctggactgaagtcaagagtccttgtcaaaaaccatcactcatcccactgattcactcattactcattccttcaaccagtgttttcggggtgtctactatgtgccagacaccgctcatactcattttagaagcccctgagaacatacagtgtgcataccaccttctgatgatgagcagtcttagttcctgtattattccttccgggattgagttatggcttttcaactggagtggaagcttcttatggacaggaatccaattttgtgtttcttttgcaagacccacaggatataatggtcccttgctacatacttacaaacaggctaatatgtcctgtatagtgcacatgctcaataaataattgttgatggaatcaatgaatgaatgaataaccagcacttctatttgaagtctcctccatctgggattttgaccttccaccagtgaaatggacattacagtgtggagtttttataaagattctaatttgaactgaaacatatgaaagagttacatcataataataatagttaacatttgcttagagctcaccatgtgttgggaactctgaagtccttattagctcacttcatttctataataaccctatgaggtagtgttattaatcccatttcacaaataaagaagcaaaaacttaaaaagggtaagtaacttatccaaggtcatgtggatagttataaacaacagagctggaactccctccattgctaaagcccaggatgtggttggaggaggttgggatgctactagaaatttagaaattgcttactgaattggtgggataagtaaatgactagtcttggataagaaatggctagggttggggattctggagttctcctttactctgcttaaactaagacacacccagagatgaaatgaaaaaggaaacatagggtccaagagatggcacacaaaaattaaaaaatactcagccctaggaaatggaagttatgggagccaacgggcagaagaaaagtgatctgaggtcatcttctgttgcatcaccgtgcatttttggcaggatttactgctctggtgattgtcctcacttaatggtcaagctcctactttagctttggcaagatcaccttaaaaatacaactattatacaaatactttttaaaaaccttggacggagtccaagataaatacatataacaaaattcaaaaaaaaaaaaaatccacccacaactgtcacctagtattactctgacctacacatctgattttcttttggtgaacagtccatcttgctaattgaccagtaatgatctttaataactcaaaaaagggaatagcattaaagagagcaagggttggggggaaagcaaggttagggacatcgggaataggaagccagcagttacatttgtgagagtagaatgtagaatattttgagggaattgggcaaacacccacgatcacacaaattaaagttctgaaaatacaaataaacagttgtcataatcttagacaactagattccatttgccttgagttacccagtttccttggggatctaccttcctccattcacagtaccttaggttgaagtaaagccttaaggatggtcaggtgactcatgttggccagtcagaacactgcaatctctagtcacagtgattggttcaaaatgggcacatgatcaactgggatccaatgagattcaattctaggactttttctcagaaatttagaagaccatttttacttctgctggacttataaagagactagggtatgttcctagagctctttgaactatcccaccaccactaagacagaacctgactgagagtaaagccaacagagagaaaacaagagccaagatacatagagaggaagcccaagttctgacttggatgtctcagtgcctgaaacttgataccactagattttcctgtcctaatggttagtaaaattcttttttggctcagacaatcttgaattgagttttctaatgtttgcaactggacatttatttatactcacattagttagaatctgtatagagggctgtaggcaagaggtggtctatatgatagaaaaaagacctcatggctattagaaggtggacatgaggcatcaacacagtgatacactttaagagtgacgccaatcttgaggtgaataaaaagtattaaagttctaaatcctcataaaaacacaacagtctcctaagctaagatacaaaagtaaaaatatgttcaggaattgacagaattccagagaaaggctatgtgtgtagatttaaggtgatcatacatggtacagaataaaagttaaaaaataataaataatgtctccattaattgatttttttttcaaaagagaatgtcttatagtataataaaaagagcactagactgagatccagaaattctgaattcaggaatttctagtcctctaatctggtggttcaacctctcggagcctcagttcctttacctgtaagacaaagataactatactttccctgaaatttgtgtagtttgattaatattatttataaatatgtataatgcacccaacacagtgactgacccataaacaaagaacaaaagagttatttttccccaaatgtgtataagggaggcactgagcaaagaatttcagaggcaacatctcacttaatccctcactgcaaacttcagtatgcgggagctactattgttacctcattttgcagatgaagaagctgatatatacaaattagtgagtgagctagaaagcgctagagctggggatttgaatcccaggttgttagagtcccaagtatctgcttataatgacctcaataaataagcactagctagtatgactttattactaatgtgtttaagtgaatagtaaaccaaagaaataaaaatagtaaaggcccagcctggaaatgaaggctgaagatcagctgctgaatcattcaaaaaaggaaatgctcccaggtaaagaatggaatgctggatggcctttaacatggtttggctctgtgtccccacccaaatctcatgtcgaattgtaatcaccacgtgtcaggggagagacctggtgggaggtgactggatcatgaggacgaatttcccccttgctgttctcatgatagtgagttcccatgagatctgatggtttaaaagtctgtggcacttccccctttgttctctctctctcctcccgccaagtaagacatgccttgctttccctctgctttctgccatgattgtgagtttcctgaggcctcccagccatgtggaatggtgagtcaattaaacctcttttctttataaattacccagtctcaggtatctctttatagcagtatgagaacggactgatatagccttcatctttatttcactgtttctccctggtatggcatgagctctttgagcaacataagaaattatttcctgaaagacataaaatactattgagaaaattacaagtgctttcttggagatgaacagcattggtctagcctgaattattattattatttttaagaagaatctatcctaaaggtgggggaagcaatgtaaaagtcctcctgtagaattctaggaacatgtctgtatttaagctgttttctgtttccatatacatccttatatatgcatcgctctccaatttagaatctcaaagaaatagaataaaacattttctggtcctagtgaggcagacacagaggaaattcatttctgtagcactataataagtagttctctttaatctatattcaggaaggtagctttgattccgtttttgtcatgtactttactcaactgtgcaatcttttatgatctgccaggaagattactcctatccccataaaacttggttgacagaaaatcagagagcattattttaattgcttcaatttccttcttccaaggagaaggcagaaagttcttcaaatatctcaatttcattaaattcaacaaacacttcctgggcagctgttctgtgccagatgttgtactcaatgctggggataaatttatgagtaagacccaggccttgctcacaaggagatcatagtgctcaaaatgcatgtggggtgctcccacccctcaccccatttccagctaagtagacacaatatgcttttaggaaaatacaattgaaataaagctaacagcattgagaaaagatgctccttgtctaagtttgaataaccagaagacgagataaccagaagatgagatagcaccaactgcctcacaaatgagatagtaatctcatttgtgattccactgagatggcaattgccataattatcattttcacatgaatttatctactgaccacctatttatatcttaggtgctccgagagacattgaatataccttagggaataaaacagttgtgaacatcctgtgcctggtgggtcttgcaatccattgtgggagacagaacaaacacataagcaaacaaatagatgtacaatattaaattatgatcaaagctaacaaaggaatctgggtagagaatcacagtgaagggggtgaggaagcctcctgcacagagttccactgggaaggcctctctgaagtgatgacatttaagcccagacctgaaagatgaaaaggagctgttcatttgaagactgaagggaagagagatgggaacagcatgtatgatggcccttaggtgggacaaagcattttatgctggaggagctgaagtacaagcttgaattcccccattatatccctatggggtctacactgtgggatcacattttcaccttttcctatgtaattatattattcaacctttgtagtttcaatacatcgttggagaaaatctgcccagaagttttcattcagtgaaagagttccagcataaccaataatgatggctccactgaatatatgttgagtttgcagaaacttacttagaagaaacgatttttgtatttctctgtaattattcataatttcttcaattaaatgcctttgcaaaagttagcaatgcactcctgtgtataaaagataaatattattctaagacacctttgcaatataaattttttatctcaaaattcctcacacttggttttgctcattggcagcaactacagaaggccaggacttgtggaggatgggagaaacctctcccaaaggctgatattttagctaagtgattttatgctttttaaaaaaattgcattgaagttcattccattacattgaaattaattcttttttaccttgctcttttgtcacctcgtaaatggaatcattgttattttttctctctgataaaattaagtcccaggatgaataaagcagaatatagactcagtcgtttatcccccattaacacagcgcaaagtcactgcatcaatggacacaagacttaatgcccttcatgaagcctcccaacattaatgtggaaagagtcaaactgctgacctaagctctgccttactcataagcactgtctccttgtgggaagtcaacaaattaaaaggcagaaggatgcaaaacagccatgccaaagtggtctgattgagttcaccagtcaacaccaatgcctcctctgctcctttccagctggtcatagagatgctgcatgcctggccatgtgaatgctgaccatacagcatcactcatcccttctcgggaagtcccaggtggttggagtcattcaccactgggtggccatttgcctgcagtgaataaaaaataagggggtcctgtctgaacaatgaacagtactgaccctctgcatgcattggtcacaaatgaagataaaatattgtaatatgaaaagctaactaatactgtacatgcatgattatacctcccatttatcagtatttgaaaatctgtttacattcctttctcttccagtaagttataggttataggtgcttctaagccatgtatgatctattttctctccctctctctctattagactttgtttttataacagttttagttcacagcaaaattgaactgaaggtatagatttcccatgtacaccctgcctccacacatgcacagcctcccccattatcaacattcatcaccagagtggtacatttgttacaactgacaaacctacataggcacatcatagtcacccaaagtccatagtttcattagatagtttacatttactcttggtattatacattccatagttttggacaaatttataataacatgtgtctatcattatagtatcctatggagtattttcaccgccctaaatatcctctgtgccctgcctattcattcctcccccacccccactaacccctggaaaccactgatcttttactgtctccatagtttcgctttcccagaatgtcatgtagttgaaatcctacagaatgaacctttttcagactgaattctttaacttagtaatatacatttacggttcttccatgcctttcatggagtctgttctttccttatatccctagcaatgagcacagtgccttacacagagcagacacttaacaagcagttgttgaataaatgggcaagggaatgagtgtttttcatggcacagttcacttaacggctgtttactgaggctttctaagttcaggctctcagccaggcatcttcaaaccataataatatttgcatgggatttccgaaattattatcttatcataacagcagtcctgagaggtagaagaacagacatttttcttattatccccatttcaacaagatcagaaaacagacacagagaagtaaagtgacttgcccaagttccctgaactagaaagtggaagagccaggactagcctctgtgactctccaatgtacctttatgccttatcctatatgttgtctctcctaaaacctggctgtgggtcattgaaactgacaaatgtttaacaagaaactaattcatgatgacatagtaaaaggtgaggactgaaagaggccctcttcccaaccttgtttcttaggggagcccatcttcttacaaaaaaaaaagtgtatccttggctttgacagtgcagcccacaccagtgaacctcaattttccattcaccacaagcaaactactgttgggctgcagaattgacatctttctggggaaggaaagtttaacaactgatcaacaagtagttcgctcccattcaacagtaaagaattgcactgatgagcttcccctgctcctgttagggattaaaagggcttcaagagtccagaccagaattcattccagatctgcagttgtgatgggccctcaaagggaaatgaagttaccctgggagttatgcctggctataagtgagttataggggaggctcatgaaggtccctgccttgaaatccagtcccctcctgaattcattcattctccaattttaacttttagcctttgtaacctccttgagagcctcatacgtatatataaatgtctgccgagaacctcccttgagtgtcctagttttctcaaggttagtatttccaagatagtgcactaccaatttcttccccaaatcctgtccatatcccgcattttctttaccagtgagtgacattgtcatagatcctatcactaaaaccagaaaccaagcccatatttttgtttaatccttccatcatctcaagtccaattagccaccaagtgtctactctgagatctctctacccttcatcctcattactgcagcctcatcaccttatttctgaataaacatagaaccttcctaactgctcttttgctttctctctttcttggccacccatttcatccctcaaatccatccttctcttggtagccaggacatgccatctacaatttgtgtcaggtcacaccccgcccttgctcaaaaccctttagtggctcggcatggactgcactccccagaatgatgtactaggttgggacctgctccctgtgttcttcccatcagtccacctgacctcctgtgccttcaggctctatagattctgggaaaccctaaaatggcttgatttcctacatgcacaccttgctgttccaaacctccatgcctttgctcatgttgcttgaaatactttcttcatgtttcctcatccacctaagttgtcatcatccttaaaactcatgctcccacagcaccctgtgcaaacctctactcttgctctattacatggaaattatttgtttatgtatctgttgccttttagaactaagatcttcaagtacaggagacatctaatcatccctctattcatcacttcttgcagcgaaattctcattttaaacatctgaagccctaacaaaccatcatgttttaaaaagaagaaattgtgtttcttatgtgctaagtactgtttccctgtacctagcacagatgcaggcacatagtatatgtctatatcagtctctgtctacatttactcattttattcaacaaatatttattaagatcctattttattcccatcactgtgttttgcagaatatgagatgttgctccagttcttgaagttcttatgtactaaataatataagcagtgcatttaaaatagtaagttgctggatcccttgcccctcatcctttctgcagaatatgctgtcttcagtacatgattatttgctgtgtgccaacgggtgccataatgaaaataataaaatacaatatatgaaaacaacaaggtgagccttgactctcagtaaaagatgtgaacacttagttcattgaaaaaggaatgcagggataaataaatatatgaaaaggcatcctactaagctaagaaaatcaagttgcaccaggaagagattttctcatttattcaattggtaaaatgttcaaaagatttgtaataaaaattgtgggtaagtctgcaatgtgggtaggaagtgtatattggtacaatatttttggtgggcctattatctattcaagttgaagacaaatttgggccttataatggtcaagaggtccactgataggaaactcttaagtgagcaaaggatgtatgtaccaaactaaatgtccttttagtaggagatcaatggggtacattttggtgcatccatataagaaaggatatcataaaaaaatatggaatgacatgaaaagaagcccttgatatgttgttaagtgaaaaaaaaatcaaactatgaaagagtgcatatagtcatttcatctttgtaaaatatatatatacacatatatatataacatatatatatacacacatatatatatacaacatatatatgtacacaacatatatatatatatacacacacacacacacacaacaaatatatatatatgtgtacatatatatttcctggaaggctagatactaaattgtaaatagtggtgtattagtccattcttggactgctatcaagaactatatgagactgagtaatttacaaagaaaagagatttaattgactcagttccataggctgtacaggaagcatggctgagaaggcctcaggaaacttacaatcatggtggaagagaaaggaggcatggcttacatggctatagcaggaggaagagagagaaaggggaggtgctacacacttttaaacaaccagatctgatgagaactcactcactatcatgggaacaaaaaaggggaagtccacccccatgatccaatcacctctgatcagcttcctcctccaacaatgggaattgcagttcatgagatttgggtggtgacacgaatccaaaccgtatcaagtggttatttcaggatagtaagattggggagggagaacttttcagcttttactttatgcatttttatatcatctgactttctccttttttcacaagaagttaggtgttagttctaattaagtgttggggaaaggccaaggcatgccagcatgctggactctgcccaacccacacagaatccctcaggctatgtgtgctgcctccaaccccccatatgaagtcaaccacgtttatctttgggaagtgaatttcctcatctacagactcatccctggattcagaaacctcttttcattcattccataaacacatattgaaatcctcttcgtgcccttattcttaagtctgccaaagccgagaggaacttagtgagctactcgggctggtcacacctgcatcttaaaagcaactctcagagaatacattacataacacaaaagcctgatttccatgtgaggggagcagaggaagcagtttccaaggacaatctgtagcagaatcacttagggagcttcttaaaaatggatttctctgagctcctctcacaaatattgaatctaagggtagggcctggaaatctacatttttttttttttttttttttttttgagatggagtcttgctctgccacccaggctggagtgcagtggcgtgatcttagctcactgcaaactccgcctcccgggttcaagcaattctcctgcctcagcctcctgagtacctgggactacaggcatgtgccaccacgcccagctaatttttgtgtttttagtaccgacagggtttcaccatattggccaggatagtctcgaactcctgacctcatgatccgcccgcctcggcctcccaaagtgctgggattacaggcatgagccaccacacccggccaaatctatagtttttttttttttaagatgtatgcagacttattttctttattaaagtattataagaaaacatatgtatttgtaaaaatggtttcctgtgtcaggcatttgggcagtcagagctgacttgtaaactattcttgtaatagctcatttggtcatatatccagaattcatcaaatctatacttttgataacctccgtgggctcatgcccactgaagacactgcagcaaaagtgaacagaagagagtttgggggctggataccattctgcaggtctccatagccttgccacctaatgggcccacacatgggaagacctgccagcccttcctcattctgagagcttcacagagaccctggacagagcagagagaagaaacaccaaagggtgggggaattaacatcactttgttaaactaagtttctattcatagaggaatttatctctagatttatctttgtatttgggagagtctttcctgcattgtctctcctgtgctgacttgactgataaccttcaatatatctctattaaataagaatcaatttttaaaaatcaacatttgactcttaaatgacatctagagactggttttaagagtaagcagagtagatggccaaaaaatgctatgttaatacaagaggttattattttttaaaggcaacaatggtggcttagaataagaagacctagggtaaaacccaggaacttgccacatgttagtataacataaacaaaacaaacacaaagctactattggaaatgatgccagagtagcttcttcctgttaccagtgtctggatcttaaaataccagaagttcaaatttgccgtggggagaccctttctttgttttatggaatcaatggttctcttacttggctgcatgtgggagctactgaagtatttatttccatctcccatcaccatatattctgatttcattggtctggcatgtggcctggacaccaggactatcttgaaagttccccaggtaattctaacttgcaccaaagtggagacaagctgcttattagaaagcctttataatcttggagatggaaggcaaaacccaccattcgggtatccctgagctgggaaataatctcaatatgggtgcttcaggctgagatgtttaacatactgtatttaagaatgaaaggtaaactggtgctgtggcttatgcctgtaacctcagcactttgggaggctgagggggcaggattgcttgagcccaggagttcaagtctgcagtgagctatgattgcaccattgcactccagcttaggtgacagaacaagaccctgtctctttaaaaaaaattaaaaaaggaaaaagtggtggtagctcaagctttgggcactctgtcaaatcccctcagcccatctctttctgccttagcttcattggacagttccgtgtaagcttgacacagactggcaacatcccagctcaagcactgtgctctttcaacttcatatctcaaaacttcttatagcaaaaggagcctccagctgacagaggctagagcaggcatgtagggcacggactcaaactatgtcatttgggcattatagagaagggtgactactaaggttcggagaagtgggaccgtaatagctgtatggccttgggcaagtcacttctccaattcatagtttccttatctgtaaatagagctactaatacttcattggaattattgtcctcagcattaaatggcacctgattcaaaataggtgcctgacacattaaaaagttttacccatattatcttactttatatccaaataattcagtaagataactaggataggtgatattgccatcatcttggggaaaaaggagatcgggaagtttaagtgacatgtctcaagtttcaaagtatcaatggcaaaaccaggccaggaactcaggcttcctgcctctgtatagccactgttttatattgtctttcttagaagatagcagaagttttcaagccactgagtaatattagaggaagaaaaaagaaactaagagagcagaaactatttttctttcagtaaatagctttttgactaaataacaaggtgagtcatttgtttcagggtgtattgtttaaacaaatatattgtttaatgactccctggctattgtccgatgcctcaatgccttttaaacacataactctgcctgaacttccctatcactggctccatctctactgttgtgttggtttgtttgcctctggatattgaatcttgcagaattgtgtctgaaaatctaacagagactcacatcaaaactgcacacagtctgcatctcctctgggctctcactttggtcatttgggctgagtaattaatgatttgtacaattgctcaacttactctaaaggacaatagtttgactgggacactgagcagacccagggctgtgttgcagccagagctggtggttttcttttttcttttattttctttttttttttaagatggattctccctctgtcaccaggctggagtgcagtggtgcgatctcagctcactgcaacctctgcctcctaggttcaactgattctcctgcctcagcctcccaagtagctgggactacaggtgcgtgccaccacacccagctaatttttttgtatttttagtagagatggggtttcaccatgttggccaggatggtctcaatctcttcaccttgtgatctgcctgcctcggcctcccaaagtgctgggattacaggcgtgagcaagcatgccctgcccagagttggtttttaatgactcctccccacccaaagggcctcccctgcaccttacttgtgctcaaattctcaaatcccaccttgcttggaggccttctcttaacgatctttcaaactcaggatcgctcctattgtttcatttggcaactatttattatttggcagtttatttattttaccccttttgtttaatcccaaattgtgttttattattagttttcctttcattcttgtcttgtctccccacctagactgcaaggtctttttttttttttttttttttgagacggagtctcattctgccgcccaggctggagtgcagttggcgcggtctcggttcactgcaagctctgcctcccaggttcacaccattctcctgcctcagcctcccgagtagctgggactacaggcgcctgccaccacgcccagctaattttttgtattttcagtagagacggggtttcaccatgttagccagaatggtctccttctcctgacctcgtgttccgcctgcctcggcctcccaaagtgctgggattacaggcgtgagccactgcgccaggccgactgcaaagtctttgagaataggaccacatcttacagttatttgtatttattcacagtgtatacatagtgctggaaatgtgctcagtatttgtggaataatgaatacctattgaatgaattcagtggcattttatagtatcaaatgttttgctggtagattccaaagggtttgtagtttccatactttatatgttttgtagtataagaattgtgatagcttgtttcaaaaataataagggaagtcttgttcttaagaatcactgcactccaaattctctatctccttacttaaaaatttaaaataagataattaaagtctccttagtatagtctataaaagttgaaacaccaattttgagattcttccagaagaacaagcaagaaaaaaataccttcccccatttttttttcatccttagtttaacaacccatattcaaccaaaggtcttcatatttttcatacagatgccatgtgtcatttcttttgcttccttcatgcatatccaaggaccttcatcataagaaggacatcactgtcattctggccggtgaatgattattcatttttccccctttacttacaacatgctaaagagctcttttgtatatctgtgtccaaaccttgatttggttccaaaatcaaaattacaatcttttggtcacaatttatccactgaatggcatgctcagtcagcttgaaggagcagattgcttcagttgtattgttgggtggaaagggctgagagagggggccaaaagactatgctcagtaataaattaatggaagaacaaaggaatgaataaataaataagtgaatggatcacctaaagaatggcaccaatgtcagagagcttccttggtttgctgaaccaagttaccttgaaacttgatacatgtcacttaaacttcctgatttccttttgccccaagatgatggcaatatcacctgtcctaattatcttacagaattatttgggtatgaagtaagataatatgggtaaaatttttatgtgttgggcaccctattttgaatcaggtgtcatttaatgctgaggacaataattccaattaagtatcagtagcactattcattgataaggaaaccatgaattggagaagttagatgatttgcccaaggatgaatattcattcattccttacctatcttgggtgtgcaccagggaagtggtaattgcgggctaactgaaggtacaagggggctgaataactacagaatcacaggaaggattggtatttggttacaggtagggattcaccaaaagacattttgctgtgtgggtggaagataatacaattacattgagaagattaggcaagtgacaataagcctcagggaaagaggatgagacctaggccttcagatagagcctgggattggcctcagtgggactttttgtattcataggactcactaatactggcttattatctggtagagctcattggcccagtccctctggtagctattcttcagtattagatatactaattctcaagtagaagggacccaggagctcacttgatcctatgccttcattttttcctttcactttcataaatgaaaaaaaaatgaagcacagatagatgttttgtccagtcagttagcagactgcatggctgaataatatttgttgtataaatgaatggattttgaactctaactacaaaatctaggctttagactgaatggccctgcctttcagagaggtgcttcccacccaggtgggtcctcatgccccatgatccccttagttgtgctctgtccttgggagaaaggggacaacccaggcctgcattaggttgacttcccagaggcccttctcttggatgattttccagcttacaccattcttcactgttactctgctaaagtcaacatgtaagagccatgaacaatggaaatgagagtgaaaaagaaaaggagagaacttaagaaagggaagtttactggcataaaaaccctacttcatgtcaacagttttagaaaaattcagtcagttctagtgggctcagccagacttaatctacattaatgaaaacccacgtgtctggagattctctctagcactctctttcccagattggttcatctggggacatgcctttctgaaacattatggctttcagaagatttcctagtttatactaatttagatattgttttcaagtaacagagaaaattgctacagcatctgaactatttatcttcctagatgttgtagttagagcaaaagcagatgagttgggaaaagataaattcactaaaattacttgtatcctggtattaaggtgatgaataacttatgatgatgtaacatctatgtactatggagataagaatatcattaaatgcatacataagaatttagctctcaataagaaacttattttaaaaggatacaatcttataggaataaaagaatactatttataaatgaagaattataactcattcatgcatagaaagccaaatattctgaagataacaaaactctctgttcttacaataataattaaaatctccatagtatattctataaaatctgaaacactgattttaagattcttccagaataacatgagggaaaatatactaaatttattttttctaaagggattggtatttaccttctggattttaaaatatgtgacaattaccaaaacatcatgacattcagttaaaagcaggaaaaagatgggtggagacaatagatatttccaaagtaaatttagaccataataagaacttattacattaaaaaaaccagatatacataggcaagaagtgatcagtatttaatacagaggacaatcaggtcatggtgcagagacggcattagattcattcctcatattatatattataataaattttggtcaaagcaaaataaacataagcataaaataaacataaaaagaaaacgaataaaataagcatattattttcaattaaagaagaaaaaacatttctgatttgctgagatataattataaataaaacagatatgttggaataaaaaacaaaagggattgtaaggaagttaaaaaattgtaagttataaatgttaaaaaggaagctctactcttaagaaatgaacagagaattcatctaattaaggtcagtattcagcttttcttcaaaatgagatcataggaaataaatggagggcatacacataaggaaatgcagacaataaatcagcacatggaaaaatgttcagtctcaatagcaactaaagagatgtaaacaaaaaacctttaaaacaccacagcatatcagttaagtaactgtaaaccctggcaattcagacaatgagctttggaatcagatagatgtagatatggatcctgccttgccactttttagctgtgtctttgattcagggtcccaacctctcagcatccattttctaatcagtagcatacagctattatacttaaaggattagtgtgaggataaaatgattaatgtaaataaaccattcagtacagtatctggcacatattgaatgtttccgttaatggtaggcagcaatagtggtggtggaagataatgatgatggtactagtgctggtaatggtggtggtgaaaatgatggtgacggtagcatgtgatgacactgttgtttgttggtggtgttgttgaagacaacgcgattggtagtatttgatttgttgctcatagtgttaataatggtgataatagctgatcatggtgatggcattggtggaggtgatgggaatgatggtggatgaggcttggtggtggtacagatagtagtacaggtggtggtaatggtagcggaacacagtaatagtggtggtggtgaaagtaatggcgctggcattgttggtagtgggcttgatgatgatgatggtggtgaatgatgatggtgatgtggtagaggttgcattgataaaggtgataatgatgctgatggtggggtggtggtggtgttcgtgaagttgatgatggtggtggtggatgacgatgttgttggtagtgatgttgatgtcgacggtagctgataatagtaatggtgttggtgtttcttgtgttgatgaaggagatggtgatagtagtggctgtggtgcagggggcaatggtgatagtattgtggtttttttaaaaaaagctaaaattataaatagcagttgtagcagttgtggcagttgtagtggataaatcagaaaaatggaatactacaaatgcaatgttattggtcttgcaatttgttagtctttctagaaagcaatctaccaaaagatatgatatgttgtacactttgacacagaagttaagctcttgggaacatacataaaaaaatcccccaaattaaaaatggtctgtaaatagtatagcagtgttatttataactgggaacaatacaaaagcctcagcaatagggaaatgactaagaaaattgtgatacatcaagatggtggaataatattatgtagctattgaaagtgaaatatgaggaaatatgcatatgaaaaactatgttagaatacacaaagctatgtgttcagagagtgtgcatttgtgtgcttttaccaaataacagaagaaaatataattgcaggtgcatagagtttaataaaggtttcatattaattaagctttttctttatatttccaaaataagtttaactgctataccttgcattgcatgcaagaaaaaccaacaccattactatcattatgcttttgtaaataattaatggtcccattaactcatgcagggtcgtggttgaattgcaaactatacctcagtccaaataactggctcctaactaactaatattgagacaggccacctccccactcctttccttagagtctgtttacagcctaccttttattgctcatcccagttcttcgttcctcactttatcctcacaatgcttaggaagaagtttcaaaagaaaacagggatttttttggttgttgtttcaaaaccaaaaaattagaggtcataaaaagcccagtggtatcaatttaattacatgtctgctcatttgaatgtgagttaggtttgtggttgtatacctaaagccccgagtattgataagttttgaattttagaacagttacctaacttctctatgcttacatttcatcaactataaaatgggagtaacaatagcaactaacttgttgggtggttgcaaagattaaatgaggggctccaggtaagatatggcagagtgcctgacacagagttaatgtttattattatttgttaataataaagttaatgtttataattttttgtattgagtcttgtcactgccatcactattatgtctactccaccaaaaagcactagaagctctcaattagaaacaaaggcactggactaccagtttcattatctatataatgggaatattagaccaggtgatttttgacttgctgtgactctgttttctaggagagaataatgttctcttttattgatttttgtctcatgtcaggaaggagaataataaatccaaaaccaaactaaaatgggctttcaaaatcactctttttaaaaattaaaatattgaattaataaaatgctcgtttgccttgcttaaatattctgaacagtttcttaactatttcaatgaaagcattaaaaaggttgtatttctgcattcaataacaaacttatctttgaaatagaaaatggcttatgaagttgaaattaatttttttttcaataatttccccaagttctgtaggttttttttgtttttgttttgggtagttttttcttttttcaaaataaatttatttaaattcccttcaagatagaaacaagactgaatggcccacctaggaggtggggcaggcaggccttgggaggcactgaggccactcggggtgtttagccagatgtccttcatactccagcacgtcacacatcatcagtacagtcatgcctctgaaaaaccctagagggtgctgttttcctgtttgttttcatccttgccttgccctctcaatgagacaatgaaaagaacaaaaaaggagggaagtagatacatcagcaacaaaacacagactatgtgtttaaacaaaacatggactacatgtacccgagcccaagatgacatggagtattgagtctcggttcctgtttgccaggtgaggatgcagaacctcagagagatggggcacttagtcaaggtcaccctgctaaccattggcaatagagacaaagctagaatccagacctcagacactcagaccttctgtgctctactacatgcctccctcaacaggtaaaacacaatgtccaccaagtgggagggccaaggcacatgcttctgggtgcacgttctctcttgcttatgtgattttgtttccaaggagcaaggttgctgactgaaaaacagagatatatttcagaagtgtgtaatttgcagggatttttaccttctgattctacatagcccacccataaatcactcctaatgactttgcgtcattagcaccaacagagttggttgcagttactagatgcaacagtgatgatgagactattaacggtgctgataatgatgtacagttattgagcaccctctgtgtaccatgtactgtgctaggtactttgtatacattggttcatctactctttgctatagccttataaagcatgtattgtattttcttattttatagatgagaaaagtgaggattagaagttttaagaagctggcctataattacacagaagggaactagattgtgaaaccaggttaatgtcttcatttgcttatgcaccatgttctcaaatacctgcaaagtacaggaaaaatgatagggctggtggtgagatagagaaaggctggaggtggtggaagtataacaggtcaacttattttggaacttttgtgctgccaaatcacataaggcaaactcctaatgtactaggttcactttttatattgaggtggagaaagttgtttcaaagtcagagggtaattgtagcagttagaagaagctaagtttaggagccacttcagagtacagttcaggcaacacacacacacaaaatctgaactgtggagatgggaagaaaggaatgtcccttcacttgtgcttcatttacttcctgagggcagctcatgcactgtgctatgtctccattcaccaatgtgaaaaatgaggagggaggtggtgctctacactgaggtatggcaaggagctctctgtatctaacttgcagagggcagcagagtttatcattgcattcttaaaaggagggacagcccactcttcagttcacagattcatcggatgccagtcagcctgctgtgtgcaatgtcctctgctgtgtgttgtggggtaggcgaagttggataagatgcattgcctgcttccatatgcttgtgggagaaaagaaacaactacaatgctgggagcaaaatagtgcctggtatctacctgcggagctgcccaaattcaaaagcagccattagcacagtagtcacccatgagggtctctgtggtagtcacctgtgaatgcttcaaaggttctttccttggaagatgccatctgttgtggcttgaagttttacaaagggttccttgctccagttgaggctttttgactaataaaaaaggaaaataccttgataaaaataaccacctcagatcatatttattccctggaatgactgcacttgacaggctcttttccgagagtagtacccaaagagggtacataaagaggggagaacaaggaaggggaaaacaagaagtagtggagggaaatggtggctttggaaagagattttacctgtatcatcacttggtttaagaccaggcctgtccagaaatttacataaatttggaaattttgcactgtggatttgagttatttgctttcagtattgttacaaaccttcagggcaaaggtaaaatggaaatggagatttggtgatcttttgcttcacatctggagagcagacccgcttgacagtggcaggaatgtaggtttcttggggtgagcctggatgaaaatgcttctgggaacttacttctctaactaaacagtcatctatttttcttatatgatttgggggccatagagtgactgaagatgaaaaagaatgcatattcagctacttgtaggattataacacaattaatgaaagttacaatctaaactatatcctactgaagacaaagaaagtgaaagaacaatagctcaaattcaaaatgtatcttgatccatcacctgacaatgagaatcaaattaataactctctcataaatcatcagaggttatgggagattcatctcctgtgtttgaggccttcattcttgagcactcagctcctccagaagcggctggcatctagcatgcttgccataaataaatcattcttagcttgctgacctggagcagtgagtgggccgtagtcccccaccacacccgctctcctctgagagtaaaatgccctgttgcatttttaataccaccctaagactctgtgtcaagtttccacaaagtttgccagaggaattagcttcctctttttaataggcagttccaagaggtcagaagataaacaagtttgaaaacaattacattttttttaaatcacttgatccaacataccgcatcttgcattttcagaaaagattggcttctataattttaccacctggtacaacatattgaaatgtactttatttaacacaataaccaccgagttattattatttttcttgcttcctttccttccttccttttgcaatgtgggaactgcctgcccaggggaatatgactcaccctggattgactcagagtatatatgacttcatgaaacaccacagagtgagggcagagagtcactggcccattctccatgatgctggttgccaagaaaccattggccttctaggtaacaagatggtctacctgtcttttggggttgttcatggaagtttacttagtgtctgtgtatctatggctccctgtttgatcaaacaagacacgtgaataagaaagcagtaagccagagaggaacttatttaatcattattcaaagtcaaaataattttatctttaaacaactatacctactttttaaatttagtaaattattacaaattataaatattttttattttttatatcttataaagttccaattatgccatattactaattggtatttaccaaaatacagctatcttccacatcttattctcttctatgaaatagtattcatgcaattttgaacatgttccagtcattggaagcactggctaaggaacgcacatgaacataagcatttggtattattatttttcaaatacaagttttgacaatcgccttacctgtgtaaaggcaggtgcaatcactttggggcatgggattggggagctggggctgaggagagggtgccagaattactccatagttacccaaaccatcttctccagtaggactttggtgaaacattagtttggattgaaagtacagaaacaaagtggactagattccagagatgaaacttgccttgcttacccctgagtaatgcttcttctaactgatgtgtaacttttcctcttggggttttagttccctccactatgtaatgaagacaatctctaaggttcctttctcctcctctgatagcttctgctgccatcttatctgcctcacttaaggaccttcctagttacagtaaaatcaacagcaaaacaagctcatcaattccacctcaatggaaacaaaagaaacgaaatgaagtgtcagtaccatttcccaaaaccaaccagtgactgttgactaacagtgcaaagagagtgggaaatggtcaaaagtctctttaacatcagaccacctggtactgccttttctgagattagacattttacttagaaaagcctgtatggtcaattcagtgtggtcacttaagagaccccatcattcatgtgaaacttgctttttactttcagatgggtgtataccatgatgattttgataaagtccacttgaaaccatgtccatttctgtttagagtagttttagcactctttctattaataacagtcatctccttaaatagaagcctgtgtcagcgaagtctaactacacaggaggtgtttgttcctaacagacatgcacaggggccagcggagatgaccagtcctcactgcatgcctggaggaagtgtggtgcccaagatggctcaaccatcattgatttgacaatttaataatcacgatggtggaaacaatctgtgtccatttatctggttagtataggaagaagcttggaatactctgacctaacgcaaggatgatttattgtcataatcataaaactcaaagtccaagacctctcactttcactgctcccttcccatgcccagaaagggacctaccgtagtgttcacatgatttatttttgcaaaatttgcaagcataagatatttgagctgcaactggttaagaccaatgcctcttttcattacagctttccctctgttatacttccactagcctcagatggtattagagttgccatgggcatcttgggtacttcactaagtgggaagttaaattaggcatatatttagtttgggtttagtgagatatatttgtgtggtcctaagttatttccggtaatagttacattattgttaaccatcatggtgaagagctggccttcagtaatactcttgatgcccattgtgctgacttcactcaggtcatgacccaaagatggtcatgtcacaatataaatgtatcctatggcatcagcaccagaaatatgcaggatatgaagattgaaatttgaaagatatagagctagaagctagtctgtgggaagttctcccagttatcagatatgtaaaattgtaaacagaggatctagttttcaccaatgcctagtcaaaacagaaattctctcttgtcaggaatatacacaataatgcaacatatacaataacaaatgcaccatatatttttcagtgggaagtacccaaagtagacttttatgtatttgcatacaaacctgtagtacttctataaacagttgcagttttacgtcccaactattaatactaaaagtcaatgttgattgatcatcctagtggaggaattgtgttacctgtcttctctcccacaaatcaggatattacaaaatcattggcaaatgaagaggcattcaaagtgtatgtttcaaaaaaaacagaaaaaacagtattacaggtatatgttatccacataataaaatattaatttaccttttgggattttttgatatctgtggtatataatagttttctaaaagtctgcaaatttgttttaattccttttcatattctaaataaatattcacttccatatctacttttttttttttttttagacaaagtctcactctgtcccctaggctggagtgcagtggcgcaattttggctcactgcaacctctacatccctggttcaagcgattctcatgcctcagcctcctgagtagctgagattacaggtgcatgccaccacgcctggttaatttttgtatttttactagagacagggttttgccatattggccaagttggtctcgaattcctgacctcaagtgatccacccacctgggcctcccaaactgctgggattacaggcatgagccactgctcccagccccatattatattttgtagttggaatttcatttttgtttctgaaggagggctccttaaaagcatgaacttcaggttcacaaattctagggctgcctctgctcctaacccagtcttagcatgggaagattttcaggcttgactcttttccatcctccctgtttcaaatactctctctgcttgctctttggcctcatacacagcaggcatctttctttccagtctctttgccagtggtaaatggcctccttttctcaaaactcaccttggctgctgcttgctttgctccacccagcagtcaccccacctcccacctcctcatcaaccccagctccattactagtccagctcctgaaacctcagccctgatcagagccctggccttcctccttgcctgggagggagttgaggctggcaatggacacaattcaatatagtttaaccagtgagaagttggcaatgccatcaggtgccacttgtctcccgggggaagaatgggggccaagagcctgcagtgtcatgtcagtcaggcacatgcagtggcttagcatcagaatgcgtggttcagaccgtggccacagtagggaaaatggactcttcatagttgccaagcaatgctaaaggtcagacaaaatctaatttgagaattcaaatttgagaatttaaaagccagagtggtcagaggcaagggaggaaaacaaaggagcttgctgttcaaaagcactttctccaggcctcctgtttgaatatcccctgcaactactagggtaaggcagatttgggaaagataggggactgattacactaatgctgttttgctttgcaaatgaaggttgagaagagcagtttaggggctgctccacaggaaaacttgtagggagtaatcctagactatctctttcataatcatctttgggattctttccctatccagggaagatgaataggtttcatcctttaaataatatttttaacctacctccaagcataacatctcccaggaacttgtgaaaacagcaagaacttgtgataaagttacaaatgctcaaaaatgtccctgtgattaagttttacccatgcttctacaagaaattaatccctctccctgtctcccttctccccttcctctcttttcttttttcatttctagcagataggaatagttgactgatataggagacaatgaaagtacccaaccattgaggggaatttaaacgccctcagtattaagcagagtatcacatagttaaaaatacaggctttggagaccaacagacccaggtatgagtccccatttcaatataaccttcagatccaggcaagagcagtcaacctggctgtgggaataggcagaactaacataaacaagaaacaaaacattgggttgggtaaattaactcagggacaaaaacagatatgtcatatagactacaattttcacttctttgccatcagcttttgacaggctatgtaaatagcctcaggcagaaagctcgagacatagcaattccaatgtttggtaagttatagttaattgtttccaaaatgggaaatgctgagttaaacaagattcaaggttttttgactgatgtctctgctccttttataagctaatgtgtactgtgaatctgcaagaggagaattagggactgtttctcaagtttctttagccatttttttgtgtggagtatctcaaggaatgtgtgctctgtgggatatatgttcagaaataagctctggccttaggaggtcccatcacaccaattgccaatatatctcctcagcagcaaaccattttaaagcccaatggatgtcactgggctgtttattcacttgtccattgatccttctccatgtttctctgtgtccctgtaagtgcctggaccacatccctatgcagagcaaccaaagttaatctgttcagttgaaagtaactgtacctgcagctgtggacagattcctgcacgtagtacacccagtctctgacgctgttgatgccctgcactctggttctgcttatttggttaaattgagttttctaacataaataaaaaggggaggcttttataaggaccttttaagaaatgaaaaccaacacaatataccatttgtccaagcacaaagtaaacttggcatcctgagatgttcaaccacatcatttcattattactgctactaatgggagacagtgcttgctagttgccaagtttgaatcatcccatcttagggcagagttactaacagatgccaaaccaatttgctgctctataaactttagaaattaaaacactaaaagatgcactggccttccaaacacagggatgttatttgaatactaaataaaagttgttgccagggaaatgggtgctttgtcttctttgccacaaaagaatcatgggctctgagacacttttgagatggcttaggtggtagcaaatacttttcaggtataatggactctactggtcctctttttttcttggcgattttaaggtcaagaaactacccttgagatttatggcaggttgtatttaaggtataaagtgtgtgtgtatgtgtgtgtgtgtgtgtgtgtgtgcattcctccccatggaatctttgaggtgaaaggacagaatttctcaaacttctagcctcaagaaatcctcctgcctcagcctccagagtagctgggactatgggcatgagccactgtgtgtgagtcaaaagttctgaaaatggagaataccaactacaaaaagatttttctgtctgccttagtcatcaacagtggcccccatctctgaactcttagaacataactgaacaacccagtcttaaattatcagcccttctctagtgtttactgtcactctttcctctcttgcacttgtaagctccttcaggatagaaattgaggctcccacttgtgtatgccctggcccttggggcaatggtactccactctccataaacatttgttgagttgagttatgttggccaggaacttggagacctgcttgctagcacaattatctcagtgtgatggggggcaaattacttaacctctctgggccagtttctatgcatctaaaacaagtaagttggttcaaatgacatctaaggtcctttccagataaagattgctgagtctcttgtttctctagctcaagtcttcacttgtaaagtgaggataaagtcttgatttagctctacgtgcaatccataagacggttagggtttctctccttttttttctgtgtttttccctgtgattctgcagttggggcaatctctaagtttaggatgactgggcaaccagccacatgatatggttagagaatgctcaaatgtcttttccctttcacgttctaactgctgtgacatggcaactgagtttcacaataataataattccttgtatttgtttagtgctttacattttataaaataccatctcatatattttatcttttgatgctcaaaactacctcataaaataaaaaaagcagatattattcccatatcacagatatggaaattggggctcaaataattcaatttgcctaatggcacccagctattatgttagtctgaattcagcctgggtgttctttccactgcactgactatctgagataaaccatcatctccacaaagtaaatctgttacttgggtgtgagtggtatttaggacccattgactcagcctccttttgcacctgcattcagcaaacattgttaatgtctactgttttgcactcccagggctagcatgacactgataaattagtctagtattttccatagtatatttcttggaacacaaaaatgatgagatttccctgaaaaaaaaaaaaagaagaaattcttgtggtcaaataattgagaaatgcttcataccacaccccctctttgagatttgcaggacctattcttgtttgcaaattgaagtgctgaaaagccttgcagtaaagggtcctgtttacacacttcacattcaccagctcccaagctgtatttagaaccctttgctcatgcacaatgattgaaatattactgtctgcagattatcctgagatcctgctgaaataagagtagagaagtaggaaaaggaacaatcttacaacagttaagaaaataagacagtgtcaccaatgacaagggttgttgacaaacttctggaagagagaagataggtaggaaaatgttgagagataatagagtacagaaaatattatagctcagaataaaccctaaggtaggtacagaggaggtgggggccctgttcttttccaggaccctagagaagctgtcagcttggagttggcccatcccacagtgggtgggaggtatgatatgggactccattggagggagtcagtgaaattctatcctagaacaactttgccagacagcagccaactcccacatcccagctctgtgcagtgcactgggagccttttacctgtggcctctacatggaaagttccctccacaggcagccatttgagggtgtggggagagcttgtgcttccagtctcggtgtggaggtgccagggtaaagactttctctttctggcatctggagatccattccctgatcaccccaaaggaatgatgattgacttggcctcccctgccactcggcccttatgatgtagtacaggacactttggaaaaggaacaatcagagaataagatcagagttattaaaaattaagaacataactgctaaaaatgaaaaatttaatagaagagctagaaataaggaaagcctctgaaatcattgagcaaaaaagcaaataaaaatatgagagaaatgactagagacagaggccaaatacagaagggtcaacctccaactaataggagttgcagagagagagagaggagagacactggagggcagggcctgatacacatatgcattcagtataatcattccgtgacagaccgcaaacaggcaaagtcctgcccctggagctgggtgacaggctggtagggcagatggacaaccaataaataaagcacaatgccagtgatataaagaaaacaggagaataaggaaacagaaattcagaggtgctatattagatggtgaggaggatgtttgagcagaacggagtgaggaattgagccgtgcccagttaacacttgctaaatgaataaaaggatgaaagtatgtaggtggaagagtgatgtgcacaacctcatattgctcaggcctatactgaacagtgctgctagatgatctctgaagttgcttataatttagaaagtggccttccctcccacccagtaaatgtactttaatcgttgaggtcggtattaatgatttctgggaactcatcacgtcccatgatgtgttggaaaacaccaggcaatgctttatcacagtctgtgcttcttagcaaactatttcctctcagctttcctggaagctggggttttatactatggctatttttagttgttgtcgcagtggctgctgggaccaattgcctaaggagtttgacgagaactttaccctggggagaggcattcctctctgcagtgttgccctgaagagccctgtaattgagatttgaccatttacaacctctgagaactagataccatatcatgaaatgcaagatcaggtagctttgctgtgtgctcagcagtcagcaagaaactgtccaaagttattttgaccagtggatcattcatttggtcagttcctattcaaaacctttgactgagataaagaagcctgttttgctttggaattgatgcttgggaagctccaggtgggggtaggctgggggatgtttgccctcaaaatgatttttcacaagagtaccccagacttgtgtgttccttcacagccagtcaaacgagggaccgactggcattcaggaaagcaacctgaaagatctagttgggatattctggcaggtatctaatctgccagcacttgcccttccttctctgctccaaggcaatgagaacaagactggctataaaacccaccactgccaaaaccatcttcccaaagcacacttctgaccttgcaaagtccctgtttaaaaccctcagattctccctgccacagaccaaacacactctaaaagtcttagctgctactcaaaggcctcctgtgatccaagctaatccctgggtataatttcatttctccagctcctccactttcaacccccttatgcatcatccaaatattattgaatgttccctataaacgagtgatgatttcccacctcgatgccttttatagactatttgtgtctcccccacacccctgacaacaaattcatatgttgaatccctaaccactattatggctatatttggagttggggcctctaaggaagtaattaaggctgaatgaggccatagggcgggggcctgatccaataggtttactatccttttaagaagagaaccagagagctttctctttcatttccatgtggagatacagcaagacggtggctgtctgcaagccaggaggaaagtcttcaccagaaactgatcatgctggcacattgatggtgaacttttatccagaaccgtgaaaaaataagtttctgttgcttcagccatgcagtctgtgtggttttgtcatggcagcctgagatgaccagtgcaatgttttggtgtatgcagtctgtcttcacaaagggtccttttttgctattaccatttgggccaaacctttcaaagagatgttcccttttctgtaaacttttctctgattttcttagccattgacaatctcatcttctaaattcccgaagaacattgtcagttcttttctttctttctttctttctttttttgagacagagtctcgctcttgtcacccaggctggagtgcagtggcgccatctcagctcactgaaacctccgccttccaggttcaagtaattctcacacctcagcctcctgagtagctggaattacaggtgcccaccaacatgcctggctaatttttctatttttagtagagacggtgtttcaccacgttggccaggctggcttggaactccagacctcaggtgatctgcccacttcagcctcccaaagtgctgggaaaacaggcgtgaaccaccaagcccggctaatttttgtacttttagtagagatggggttttgccatgttggccaggctggtgtggaactcctgacctcaggtgatctgcccgcctcggcctcccaaagtgctgggattacaggcgtgagccaccgcgccaggccatcagtacttttcttttgaaaaatttcactttttgatttaataatagttacttgtaaatacaaaatctttctgagctgaagacctgtgaaggcaagaacagtgtctttttccccctcatgtctcccataagcatcttgcaccgcatctctcacacatgggagctggtggctgtcctttactgagtgcctctctgtgctaggcatgtgtgagatgtgaagtgttcagctggaatcctcacagtccatctgaggattacaactcttacaaggaaggtgttgtcttctcatttaaaacatggtgaaacttactgtatgatgccctttgtatgaggtacctagagtagccaaacacagagacagaaagtaaagtggttattggctggggctatgggaagaggtgaatggggagtgactgtttaataggtacagcctttgaattgtgcaaaacaaaagttctctgagtgtatggtagtgattgtagcacaacagtctgagtacatttgatgccactgaactgtacacttaaaaatggtgcagatgttaaattttacgttatgtatatttttacctcaatgtaaaaaatagtaaaaactgaggcacagagaaggaaagtaatttgactaagatcatcaaactagaaaggggtagtgcttagatatgagccctgtctgcccacccctcttgtatggtgttttttgaggggtcttctttccctgttgcttaaatgttggtgttcctcagggctccatacttagccctcttgaattctgggctcagaattgggaaaaagttccccttctggacaaataatgtagaataaatttcccctccttgcagaggcagccctgcaggcaactggcttcttgggttgactgggctggatgccagaaccatctccaccactgcacccccgacaaactagccaggtaccctcatatgtggtacaacctacacaattagtggtgtgttgagcagctcgtcccagctcatgacagccagctgtgcccatctctttccgactccctgttcagtgatgccatattggtagcttgaaatcagctatggtgggagaacttacactacagaaatcagtaaatgctaaagataggagtccccctacaccacagagaccaatgttaattatttactgggataccactatgcacaatgtacatgaaagccttattgggggactctacttcttttggggcaactctgtttacatcagtgactatagctattatctctacaagtcaatgagatctctgtatctgatcttgtttctcttttaaacttcatactcatatgccttcctgcctactgcacaaatcagtttatataattcaagggaagaataaaatgttgaaaaccctcctcaccccccaaaaagaccaatctgctcctccctaatttctgctgtcacaatccacatggtcttccacatccagctgggtaccatgcatatctcagaagttctaccttctaaatggttttcaaaatgatcctcattgcattttcttactgctactcatgttgattcagacgcttatcatctctccccagtggtatgatgttgcattctattcatctgagcctgctaattggtctgcctgtgatatggtttggctgtgtcctcacacaaatctcaactttaattgtatcccccagaattcccatgtgttgtgggagggacccagggggaggtaattcaatcatgaggactggtctttcccatgctattttcatgacagtgaataagtctcacaaaatctgatgggtttatcaggaatttctgcttttgcttcttcctcattttctctggccaccgccatgtaagaagtgcttttctcctcttgccgtgactctgagtcctccccagccatgtggaactgtaagtccaattaaacctctttttcttcccagtctcaggtttgtgtttatcagcagcgtgaaaatagactaatacagcttgcttctatccttctcattgaaccagagttgcttttgtgggcaaatgtacttaagtctattctgcttaacttttgatgactccccattacctacaaggtaaatttcagactccttaatttggcacacaaaacctttcacagcagggtgccaatttgatttcaagcgacagccctgcaggcaactgtctttttgggctgacttggctggataccagaaccatccccacccctacaaactagccaggtgccctcatatgtggtacaacctacacaattagtggtgtttagagcagtttgtcccagttcatgacagccagctgtgcccatctctttccaactccctgctctactgactctattttatgaactacttgttgatctcaaataccctcacattactgctactgcctggtcagcttccccttcccttgttccacctaaattcctacatgacctttacaacccaactcacacattgagttgtgaaatctttctgggctttctccctgcccctgaaagatcaatcactccttctccacacattatcactttgtataaccattgtgtatgtgtgtgtgtgtgtgtgtgtttgtctggatatgtctcttcccacctatattaagaacacttgcaagacttttgttcatttttatcatttcaatacctagcagaaaatctggcatatagcagacatgaattttaactacccagagagatacaaagttgaaattaaaattatttttgctcttaatgataagaagatttagagggaattttccatctcctgaacacatgtaatgcatcagtgattcagttaagcacttcactcttcatggcaagtgtctgtggtgggtatcataccacattctataaatagagatgtcaataatcagagatattaaggaatttcctccaaggctaaagagttagtaaacggcaaatttgagatttgaattcaattgtacttccaaagcttgtgcctttcctactcctccatgattcattttaacaaagaaaacctttgtgtgaacaaataactgattcaatgtaatggagacaatgtctggaatatgtgcaaagtgccatgggcacaatctggagggacctgctgaatctgggtggctggggaccagagaagtctttcatagtggaggtgaacttgtgttctttgacagatactgcagagggactcactacaacctttacaaacctacctggtatggcttcttgtactataaaggctcaacggtggaagaaaaaaatcccagattcccttgcagctagagtctaggtgttccagattccacaaaaaaaaaggtataatgtgcgataacaggttggcagaaggagccacactcagcagcagttgcatgtgatcttacaggagaacaccatggcagaggcatttggttctgcaggttgcatctgtgttggaagttctggtgcacagtccctagtaccatagatgccaacagcaggaagctgtggggttttttctagaacaatctcagagtgtggttgagtgtttctccaggctcaacctggatgtgcagtacttaagcttggttggtgtctacccctaagtagaaatcctgtgagcttctcaaatctgtaataaatccctctctgcttaagcttactagagtggattttcttgtctgcctctaaatccacttaccaatgcaaacactgttgtggagaatgatccacttgcctctatccttctggagagataatcacacaagggtgtagcctgtcttagcactgtcaagaccaaggccacattgcatacggttgtacacaaattagaaatataagtgtatgtgttagggtttgcaacagatatgtattcatgctattcctattatttgctttaattttgtatttaaatttatttgggaaacttgctattgttgctgtaggcagagccagtttggactgcaggaagttttgcctctttcatgtacaaatagcctgaagaattgagtggcagtgatatggctgcttctcagaaacagtgatagtaaattcaactgttgggacattcgagggagctccctccacatgccaagacacatgccaggtattgtgttggaaattctatttcagtgttccaaacaagcctgtgaagtgggcattaatgtcccatattttagatgaggaaaagaaggctccataaggttaagacactgcctaggtttgcccggattgcaagtagccactgagactaaagtcagtttgcactcagagctgcatgcccttcccatgctgccagtctgcctcccagagggagtgaggaagtggaagtataataatcacccctctcacataagaacaggattgcctgagtttgtggggtattgctcaataaatgtttggtcagaccaatgtcctagagattttcctcaatgttttcttgtagtagtttcatagtttgaagtcttagatttaagtctttaatccaattttgatttgatttttgtatatggtgagagataggggtctagtttcattcttctgcatatgaatatgtagttttcccagcaaatattaaaaataaaaaaattaaaaaacaagaggagaacactgatactacagagacatctttctaaaccaaatagtttctgtggtataatttaggaggcatagtcagtctctttgagtctcaaatatggtgaagcagatcctgtccagggccctgctgacatgagtattttggtaagaagagctgaggcatccatcaggatgattatgcaagttggtttgccctaaatacggtgtatttacttattaaaaatttttttaattaaagaaatcaaactgacaattatggaaattacttgtaaaattattgaggttacttttaagagattctcaatgtaaatacaagtaaaaacaatctctgtgaaaaaagagggtggggtgggagtgggggtgctaatagttgtatggtgcttattttgtgcctagaattttacatatataaactcatttaatcctcacagcaatctagtgaaaggttaagtagattgcccaagatcacagacttaataaatgacaaaatcagaatttgaacccacacgctcttgcttgagagtgtatgctttgatccactatgctaaacctcctcttaaagcagcacaggattgggtaggacaatgtaattgctgaggcctggaatctcttccctgatcctacctgccaccctggtgcctgcattttttttcagagcttaaagcctgcttccttcatgaaagcttccttgaaaaatccagtcctgttccatctctgcgtgccttcagtggttattcagtactgagcattatatgctctagaacctgattccaccagaactctagcattaattcctaagtccttcatgttgtgaatccttcttcctgaaccaactggtcacagccccacagaaagaacgaacccccaacttggactgttttcttatctcttgcagtatctgcacattaggtacagagtgcgggttctataaagatttatcaacctgttgatttgacatattaaagagagacataggaaggaataggcaatagacgagaggctcattcttgcagctataaaatttttattatggaataagaactcaccacactcacaagagaattgcttaaccatcacctttatagatttttgtttttgtttttgtttgtttgtttgtttgtttgttttagacggagtcttgctctgtcaccaggctggagtgcagtagtgcaatcatagctgactgcaacctctgtctcccgggttcaagcaattcccctgcctcagccacccaagtagctgggactacaggcatgcaccaccatgcctggctgatgtttttgtgtgttttattagagactgggtttcaccatgttggccaggatggtctcgatctcctgaccttgtgagctgcccgccttggcctgccaaagtgttgggaatacaggcgtgagccaccacgcccagccaacaagttgttttgactgagaagggtggtcaagtgcactgtcctgatgtctgtgtcttggttccaggcttaatgttgcatttggccttagagactagaggggcaacatcctcagtcctcaaagtttctgcagctttgatggttcctcttggccaaagagagacacttaatgggcctggacgtggccattggattttgacagctttatggagatttgtaagggctgtttgctttgcctaatagttatcatttcaaaccaatagattcataccaagttgtatcacagatgttctttttcagtgtgaatacttttctccaatggtttctttattttgtggacatgaaaactcatctgtctcactaaatcccatcactccaccttttatattcagacaagaataaagacccagggaagagcctgtgaccacagaactgattggtcttcaagccagatctgaacccagatctccctgtaatagcactgtcctacagaatgttctgtgatgacagaagctgccttttccaacacagtggccattagccacttgtagctgtagagcacttgagatgtggctggtgtgactgaggagctgcatttctaattttatttcactgtaattcatttaaatttaaacagccacatgcgctaatggctaccattttgaatagtgcagttctagaagaaccaagccagtttatagagagctgctattgtaaatataaaagattactcaccatattctttcctttcttgccaccaaagaagaatataacaaaaatacttcagtagagtgtaaaaaaaaatgcacttgtggttcaacttttaacaaaaggcattcatgccaggtatttcttaccaccttgcatgtttactttgtggttgttatcactgaaacctcagaacattagttgtttcttaaacaatgtactgtcttatttatttaagctgttgccatgttactgttgtccatggtgccctgtgcatggaggctgacagcctctgacaggccctgcccttctgctgacccccaggctcgtgaagggaggcagaagggcactgcttataaagcataaaagtgggacatgccttcgagcccagttttctaacctttgtcctcacaagattgcacaaatcacttggttccatgcctgaaacacatgcttcatgcacagggagagtctgtcatacttttgagggagtgttacccatctaggagcagagctgctgatcagcgcattttcctaggtacgcatcacaattcatgcacaaatagattctcaacacttggggctgagtattggaaggtagctggagaatgggacttcattttggcaacaataaattccattttttctagagttttctaaagaaattcatagaatcatcagaggcttgaatggtaagaggttaaaagatgaagtgacattgcacttaggctgtgtcagtgaatgactggctgaggcatctgtttccctgttttctcattgctgaaaaatggtatgctgccttttgcaaagtctttattttgtatctttatcttaaagtggaagataaagactttgaaaaagacagcatatctttaaagagaatggaaacaagggtcagaaaggagttttttgtcagaaggccaaaatatgttgctatagctgtcatctcacaatgtcactttaatgattattatcactggattttagtccagttgaactttatgactacatgccaaactccaactcattcttgaacccaaaagggcaatattccagaagaacagagaagcaactcaagataaatggagatcttagagtcaattgcaacaacctccacttctggcctgacagagtaaaagaaaccagatttacccttaacaaatacaacagtaccaacagacaaagtatatgaaatgatggttttcagacattaggaataggatacacgggacccaaacacagcctgacagtctctctgagttgagcagacaatggagtttggagttcgggaaggtcaaggcagatagaatttacagatctaaataccagaggagatgcagttcctaacagagagagagagcttagagagcactcttgagatgtgcagaggagtccccttgaatctttgactaagtcctgatctgcatgtgcatgggagaaaactatcaagtatggggaaagaactagagatgcataaaagaagcaatcccaggatcttacacagggctggtaataatttgtgttcccagtaggaagagtggaaagacctcctagtacacagggcattgggcagagtcctcggaaggccattgcttcggtaatgaagccacatgagctgtagactagggcgtttctggacccacttctacaaagcttaaaagcaaggctcaaaaggattaaattcattctatgtcacttaactatatcccagaatgaggcctgacactttttaaaggaacacaacaaaatccagtatacaacaacataaaattcagtatgtctggcagccaaaagatattactagtgtatgcaaataactaagaaaatgcaactcataaccaagcatgaaaaatatcaatataaacccatatatggttaaaatgatcaaaattagtatataaggacattaaaactgctatataaacatacatcttatgtttaagaagatagaagaaaatatgaagagagaattgacaataaattcaacaatttaaacagcaaataatttgaaggaaacaaattatcaaactcagtgacaaagaaagcaataacctgaatatccctatatctattaaattcactgaatttgcaaggggaaaaaccttcccaccaagaaatctctagtaaagatagttttactagtgaattctaccaaactattagggaagaaatagtatcacttccacaaaaactctttcagaaaatagaagaggaaacacattcccatctcattctaggtgggcattatcctaatattaaatccagacaaatacacctgaatatttctcatgaatatgcaaaaatatttaacaaaattgtagcaaatcaaatctagaaacatatctacaacattctacatatcaacaacatatcaacaacattgttgtaaattcaacaacaaaattgtagcaagtcaaatttagaagtctataaaataataataaatcattactaagtggggtttagcccaaaaatgcaagatttgtttaacatttgaaaattaatcgatgtatttgacattaaagggaatgaaggaagagaagaagggagggaggaaagggaagaaaataaatccatatgttgtaccatatacaaaataaacttgaagtggatgatagaaccagatctataaaagttctggaagaaaacaaaaaatctttgtgaccttgggttagacaaacatttcctagatagcacacaaaaaacacaaaccatagcattaaagaattgataaatgggtttcaccgaaacaaaaaagatctgctcttcaaaagacactgtcatgaaaatgaaaagtcaggccatacttataaactatttgcaaaacatgtataaagaaattgtcttgactatataaagaggttttaaaatttaatagtaataagatcaaatgctaaaataataagcaaaatatttgaataggtgcttcaccaaagaagacagaaggatgactaataagtacatgaaaagatgctcagcctaattagtcactagaaaaataaaaattaaagctacaatttagtgaaatgccgtgatatatttatcagtatgcttcaaacttaaaaaactggcaatgctgaatcctggaaaggcagtagctagaaatctcatacaaattttgacagccactttgaaaacaattttcaaggtttttttttttttttaaaaaaaaggttaaacattcactaaccatataactaaatagttccacttctaaatatttacccaaatgaaatataaaacataatcaacacaaaagcttacacataaatctttatagcagcctcatttttaacagccaaaaactggaaaagaatccaagtgccctcaactgctgaatgcataaaaagttgtagcacaatacattcacacaatggaatacaactcagtaataaaaagggaccaactgctgatttacgtaccaacatggtgagttcaaaagcattatgaaagaaaccacacacaaaagattacacagagtttaagcctatttatacaatatgttttaaaagcaaaaactgtaataatagaaagatccttctaggaggcaggaggtgtctgggaagggactcacagcaaaggaggtaagacagagccttttgaggtgatgggaatgtgccacatcatgattatggtgatggttagatgactgtatacatttgtcaaaactccctcaaatgcacacttaaaattgtggacttttaatgtatgtaaattatatcccaatactgttggccccataaagcaacatacatactagggcatatggtataatgcatttgtgtcaaataaaattaaaaaaggagagaattccaaatatacgaacttgtacacatatttgctggaatgcacataaaatgtctcaaggggcatattaatgaaatgtgtagaagggactgcctctgaaaatggaaatgaggtgtctgaaggagtatggttgggaagcaactctatcttttgtacttttcaaacttagaaccaggcaaacaatcaacctattcaaagcgggggcagggggcaatgtcagctgggttccaaaacctgctgctgctcaacaggacttgtcaaaatcctgtttctatgtgggagcacctctattttttactcactatatcccctttttcccatttacaaaatcacaggatgcctgagtatgaattttccttctctgttttctccctgactagctggtttgtcaccaggacttgccatagaccccactctaccctaaagtcaaatatcaatagctgcaggtactcaaggatctttgcttgaatactgaccaaatttcccagaacacaccaagaagctttccttccaaaagcaaactgaactatcccccgccccccataaccaatttggtttaaatcaacacatatttatgagccctgactatggaccagactttgtgctaactgtggggggtacatggttgaataagatgtagctggaaagtgctttccttgtggagctttcagtcttgtaatagactgggggagatacacacttaaccagataattttaaaatgaggtaagaggtgctaaaatgaaggcaggcactgagggagaatacctagaatgatctgaaggttcagaaactgcttcccagggaaaatgagttcagaaagatgaggatttaaccagatgaaggagaggagaaggtgttgtaggcagaggtatcagcatgggcaaagctggatggagcagaacagcatcctatttgtggagagctcagtactcctgggacacggtgagtgaggtagagcatggtgggagatggaattagagaagccattaggttgctaggggcagaacatgcaaaggctttgtaatgggacgctcaaaggtgaacttgatcatgttggcaatagggaaggtttacagcaggggaattgagtatccaatttgcaatttcgttccaagggatggtctttactccactggttgaatgaaggctagctgagggtctcagggataactgtttagttcactttgaccaaatttaccgagtccccactacaacaagctcagtgcccccacaggacacggagctaccgagataagaaacaagattcgttccccaaggagctgatagtctggtaaattgccctttaaaaaatgggagttcaaaaaatgacccccaccgactagtctaacactatctcccccttgatattctgattggaagccacatcctggccagctgatattctctcccgcagggttgacactgaaccttttctcctgatcaccacgtctagtttggcttctgtgtctgttgacaaaacagtgttcagtaaatcatattaatgcagaaatacaaaggcaggcccaggaacaaggatgcactgaattagttctagccacatggcttccacaggctgctccttgcagtgtctaaccccagttgctgtgcaaatcctcaagccctttgactccaatgtccctttagagctcaaaagatcaaataagcactcagcgtactggctttctgtccaacttcaggatgatgctaggaatgtgccaggcattctaatgagtgcctgagaactaaagagatgaagatacaaacagtccactaaattcttacatagtcccttgcatcaagggggaaatatggattctggaactggctgcccatgtctgggggttcccattcaatccaactcattcttccttcagacagtagtgggttgaagagtggccttaaaaaagttatgtccacctggaacctgaaaatatgaccttatttggaaaaagcgtatttgtagatataatttaagctaaggatcttgagatgaaatcatcctgagttaaggtggccctatatccaatcccaagtgtttatcagagaagataaggggaaacagatacaggaacaccagggagaaggccatgtgatgaaggaggcagagactggcgtgatgcaaccacaagccaaagattgccagaagccaacagaagctaaaaagtacaagaaagaactctcccctagagccttcagaaggagtgtggccctgacaataccctatctttagactctggcctcaataactgtaagagaataagtttctgttgttttaaaacaccatgttttcagtaatttgttacagcaaccctacaaagctgatacagagggcttggactaccactcttactactgctgccagccactggcccaaggcttcctcctccctcattaccctggagattcctgggggtaacttatttcctccctccttccttcattcaaccatcattttaagtatgccaatggaccaagtatatgagaatggaggcagatcttccttcaggagttcacagctagggagatataaagatataaacaagtaatcatagcatttaatgttatggcccgaattgtatacataccccccaagtttgtatgttgaaatcctaaacccttggaatgtggctgcatttaagatagggtctttaaagaggtgattaagttaaaatgaggtcattagggtgagccctaatccaaaatgactggtgttcttataagaagagaagattaggacacaaacatgcacagggggaagaccatgtgaagacacagagagaaagaagatggtgatctacaagccttggagagatgactcagaagaaaccaaccctgccaacaccttgatcttgctcttctagcctccagtattgtgagaaagtaaagttctgttgtttaagccacccagtttgagatactttattgcagaagtcctggcaaactaatacattaaggtaagaacaatgaaggagtgcagagccaacacagcccagccttttagggagggacgaggaaagccctcctgaaaaggtgacttctaggctgcatttgaaaggacaggaaggaaaagcattgaaagagggcaactggagcaaaggcccagaaccatgaagtgtgcagggaagtacaggctagtgaatgtttttaagacacagggtgaatgaggagtgacaagtaatgaagtcttagctaaaagtctgagtatcatgaaaaacttttatgcattcgctccatcctggcctttttcctggagcaatagggagctactgcataactaaaatcaggggaatggcatggtctgatgtgctctaaagaagcacatgtgaaagagagaagatccaaataaacacaattagaaacaacaaaagggatattatcactgactccacaggaatacaaataactatcagagaatacgatgaacacccctatgcacacaaatgagaaaatctagaagaaaattgataaattcctggacacatacaccctcccaagactgaaccaggaagaaactgaatccctgaacagaccaataatgcgttccaaaattgaatcggtaataaatagcctgccaaaaaaacaaaaaaagaaaaaaaagcccatgaccagaaagattcacagctgaatcctaccagatgtacaaagaagagctggtaccattcctactaaaacttccaaaaaatggaagaggaaggactcctccctaactcattctatgaggccaacatcatcctaatagcaaaacctggcagagatacagcaaaaaaagaaaacttcaggccaatatctatgatgaacattaatgcaaaaatcttccacaaaatactggcaaactgaattcagcagcacatcaaaaagcttatccaccatgatcaagtaagctttatccctgggatgcaaggttggttcaacatatgcaaatcaataaatgtgactcatcacatacacagaactaaagacaaaaaaacgtgattaactcaatagatgcagaaaaggctttctgataaaattcaacatcccttcatgttaaaagctctcaataaactaggtatcaaaggaacatgcctcaaaataataagagccatctgtgacaaggcaagatccaacatcatactgaatgaacaaaagctggaactataccttttgaaaaccagcacaagacaagaaggccctctctcaccactcctattcaacatagtattggaagttcttgccagaacaatcaggtaagagaaagaaataaaaggcatccaaataggtacagagaaagtcaaactatccctgtttgtagatgacatgattttatatctagaaaaccccatagtcttggcccaaaagctccttaagctagtaagcaacttcagtgaagtttcaggatataaaatcaatgtacaaaaatcactagtattcctatacaccaacaacagtcaagctgagagccaaatcaggaatgcaatcccatttatgattgccacaaaagaataaaatacctaggaatacagctaaccagacaggtgaaaaatctttacaatgagaattataaaacactactcaaagaaatcagagaggacacaaacaaatggaaaaacattccatgcttgtgtacaaggagaatcaatatcattaaaatggccatattgcccaaagcaatttatagattcaatgctattcctatcaaactaccagtgacattctacacagaactaaaaaaaaagaactatttaaaaattcatatgaagccaaaaaagaacccaaatagccaaggcaaccctaagcaaaaagaacaaagctggaggcatcatgctacccaacttcaaaatatacacaaggctacagtaacccaaacagcatggtattgatacaaaaacagacacattcaccaatggaacagaatagacagccccaaaatacggccgcacacctataaccatcagatcttcgacaaagctgacaaaaacaagcaatggggagaggactccctattcaataaattgtgctgggataactgtctagccatatgcagaagattgaaactggaccccttctttatttcatatacaaaaatcaactcaagatagattaaagatttaaatgtaaagcccagaactataaaaaccttggaagacaacctaagcaataccattctgggcatagaaacaggcaaagatttcatgacaaagatgccaaaatcagttgaaacaaaagcaaaaattcacaaatgggatctaattaaactaaagagcttctgaacagcaaaagaaactatcaacagagtaaacaacctacagaacaggagaaaaattttgcaagctatgtatctgacaaagatgtaatatccagcatctaaaaggaacttaaattttttttcatataaatttaacaaatttacaagaaaaaaacaatcccattaaaaagtgggcaaaggacatgaatacttttcaaaagaagacatacatggggccaacaaccatatgaaaaaaagcttatcgctaattattagagaaatacaaatcaaaatcataatgaaataccatctcataccagtcagaatggctattattaaaaagtcaaaaaataacaggtgctggcaaagttgcagagattaatgaccacttatacactgttgattagagtgtaagttagttcagcctttgtggaaagcagtgtggtggtgattcctcagagacctaaaaacagaatgacccttctacccagcaatctcattactgggtatatacctaaaggaatataaattgttctatcataaagacacatggatgcataagttctttgcagcactattcgcaatagcaaagacatggaatcaacctgaatgcctataaatggtagactggataaagaaaatgtggtacatatataccatggaatactatgcaaccataaaagaacgagatcatgttctttgcaggaacatgggtagagctggaggccattatccttagcaaactaatgcaggaacagaaaaccaaacaccgcatgctctcacccataagtgggagctaaatgatgagaacacacagacaaatagaggggaacaacacacactggggcctatcggagggtagagggtgggaggagggagaggatcagggaaaataactaatgggaataggcttaatacctgagtgatgaaataatctgtacaacaaacccccataacacaaatttacctatataacaaatctgctaatgtacccctgaacttaaaagaaaaaaaaaaaaaaagaaacacatgtggatcattcctgtggctaggtggggggaggggggatcctagggagatggatgactctagaggcagagtgaccagttaaacagctgtggtcaagatgacactgatcagtagtggccaagatgaagaggagagaatattttcagaggtgaaatcgattgcactattgaaagtaaaggagaaatgcaaatccaagttattcagaagttttagtttgtacaattagtgatgctgtccaggatgatgggattagtagtgcatgcattgacattgagtttgtagtctcttgggggaaaaattgcaaaacattctttagaaaaaaatatgggccctaatttggggatatgtatttcagagtatcacatcactttcattttcagagttaacataactctcacatgattatttggtgatgcttctttattattctttcatgaaggtttcttcccatggttcctaaaggtgctaaaaggcttagaaaaggatttgtttcaccccatagcttattctacccctcccacatgggcacacaaggtgtgagtacccaggcagggaaagtggaaagcatcacagtgatagttaacatttctgagagttcatggaccctcctgaaatcatctggcacaaatatttttgcatagggttctagaatgttcctcaaccttctgaagcatattcatgaacatatgaatatattcccaggctaggaatgccgatataaagaaaaatcccctggatggacagcccaatgtactagcttgccagtgatttgcaggcagccttaggaaggttggttcactcctctgactttccacattcttggcacagtgctaagattctgagagtctttgattaatggcattgattcacaaagcaaaccagttcatatgggcacctagaaaataattttgaataaaactgggccttgattgtgttcccagcactctaattaagtgagtccagccaggctatctcaccccatgcaaacacactttttaaactggaaactatactaaaataacaatcaaaaccttgtgctgaatccatatatctcccccttaccctcacaaaatataaagtagctggatacacagatagataatatataaatcagcatcacaccagctagctttttccacgaaaattggtttatatgaagccacagatttaaatacgtggacacatccagatgatcagttgaagagatacagtgttaatgatatatgatatatttatatctaaatacttgaactaatctttgaaacaaagcatgatgtctgtttggttctgttctagctggtaggtggaaattctttttaatttgcttgctgtcctaaacattgttttgctcatggtatcctcctcagaacattctattactcttggttgctctcaggataagatccaagccccttagtttgcagtgaaaggcagcactcttagttattcaacttcgtcatctgctcttcacctatgtgggccttctgacccactcaaccaaatggaccttgccatacacatgtgagtgttggctgtgactctgcttctgctgagcccactgcctgggacgtcctttgagccacatctcaacatcccaatccagcttcatttatctcatttcctcaaggggattttataagtttctcacctgcaatgataaaactttgtttgcctccaaggtaaatgcactaaatgtgttgcttatgaaagcatccaggaagaacctaggaagtaaggggatctgttctcatcagctcttggccaaggaaagaggtccaggcccacagatcatagcagaaaaggaaggaaagcctacaaatcagtaatgtttttttaaaattgcatatccctatcaatataaaacatttacccacaatatatgtatatttactcacttacaaattatatatgtatatactactgtaagagtacactgtgctcattgtaaaatatataaaatattaacatttaaggtggttagataaaagttcaatagaaatgttgcttattatttttcattctaattatagtattctaacaccacatggattatgttgagtgccccattttgaataccatgacccctataaccacatcaggcacctctgctatggcaataatagtaattacgacaattctggagcactttactatgctgagccaaattatagtgaataattcctttagaataattatgggctatgagtctaaaaagtattaaccagtgttgttctgttgcctgacttcaacaggacatttacattttctgtgaatagtgccccctaaacttgttcagtgcacaacctgtgcatccccgcatgagggccctataagtgttctatcagagataggctctgaagctgcagatactttccaagggacaggcttcacgtgagctgagtgtggacaggagtgttgttcttatgtcaacttttccaaccacagccaaatctagaaaccatagtcagtgttgagcagtatcttagagtggataataggtggtgccatatacacatgtacacactgaccaggagttggagccatacaccttggaatctaagactgtaagatctaggaaagattcctttcaaggatgaagaaatttgggtccagggacattttatgcaaaagtattgacaaagttgtgttagaattccctgaccactgctctttccacaatattgtattgctcatgtttgaaaaacccagtaggatatttactgaatgcttgctgcaaagcactatgcttaaaataaaacgtcatttcctgaatggttccaatttatcacaataagtaataatttaggctcctatatattgacatttaccatatgtcagatactatattaagcaacttataagcattatcttatttaatctttataataaccctatgaggaaggtatcataatgtccattttatcaatgaggaaattgaggctgagagaagctcaataatttaacagaaattaatctgctaaagtaggtttcaaatccatgcaaccagacttcaaaacctgctctaggggctgggcacagtggcttctgcttgtaatcctagcattttgggaggctgaggtgggagaatcacttgagcccaggagtttaagaacagccctggcaacggggcaagaccctgtctctacaaacaaacaaacaaacaaacaaaaaatttaattagatgggtatggtggtgcacacctgtggtcccagctattctagaggctgaggcgggagaatggcttgagcccaggagattgaggctgcaatgagctgtgtttgcaccattgccctccagcttgggcaacagagtgagaccctgtctcaagacaaaaacgaaaacaaaaacctgctctaagacatattccgcttccataataaatgacataaattatgtataggacaaatggtgtttatttgtaccattttcttttgcaataaccattatcagaatactttcttcctttgcattaaacaaaatactagaatgcttttttctctctccatctctctcaccacccatcccctctctttaacatacatacatacagacacattagcgaatatcagctttctcattcgcacattttctgagaaggggtccatagctcactataatctctagagtcaaccatggctctttatttttcttttcacccacatcaaattcttcagcaaaatgcttgggctttcccttcaaaacaatcccaatgctccactgctgtcacagtaacgcaccctcatctcttgcctgaagtttgtcagttgcctctaaactgtttttccctgttactgtgtctacccgtcccagctacagcctgttataaaaaggtggccatactgttccttccaaaatcgcccaatgcctcccgctgtcactcagagtgagtgaggttcccctagtggcccctaaggactgctgtgatcatggtctgtgcctctgcacctctccagcctcatctcctaccaccttgcctccctggctcacccactgcagccacactactgcctcgcgcctacttaccgtcactctccatccgccaaatatggccatgtccgaattcccagaagctgcagattactttatgtgacaaacggacttgcaaatgtgattcaactaagaattttaaaatgaggagattatcccggattatccttgtgggtccaatctaatcgcaaagttccttacaagagaaatgcaaggagagtcggaagaaggcaatgggatgatggaaacagggcgagaagaggtgatgtgatgtgggccatgcgcgaggaatgagatctgcttctagaagatggaaaagagaaagaaacaaattctccccagagcctccagaaggaaaacagctctgctgacaccttgagtttagccccataagactcatttcagacttctgacccccagaactgtaagagaatatttgtattcttttaatccactaagttttaggtaatttgttagagcagaaataagaaattaatacacccatatcctgttttatagcattttcaccattagccctattttatatttatttgtttatttgtttatcagttgtctctcccactacaatgcaaagtgcctgggagacatggctgggcgcggtggctcatgcctgtaatcccagaactttgggaggccgaggtgggtggatcactgaagtcaagaaatcgagaccatcctgaacaacatagtgaaaacccgtctctactaaaaatacaaaaattacctgggcatggtggcgcatgcctgtaatctaagctactcgggaggcagaggttgcagtgagctgccctccagcctgggtggcagagtgaaactccgtcccaaaaaaaaaaaagtgcatgggagacgagactttttttttcttcattggtgtaaacccagcacctgacataagatctgttgaatgaataaatgaatgacatatgttacttaattaaataattggtcaacactctgaaatgattaagcctcaataaaatgttggttaaacatatacttacaaacctgcatgacattctcaccaacatgtctagaacaggtgaaaacatacacaaatgaatacaagtatcaatgcagcccagtggtccacactaaaacagcccaggagaagaacatccagaactgaaaagccgtaagccctactaggaagacagtgagccacagagctccctccagtgtgggggaccaacatcccttccacagagcagggaagaggaaaaggcctgagaggtcacactcacaccctacagtttcactcaagcagagaaggccctgttttactcgattttatatattctacttccattcaacattgggtaaggaacttcagtgaagatagggccgagtgtggagctaggaagcagggattataactgccgctctttttattactgaatatccttaaaaaggagtttatgcatagaagctgaggtcagtgggacactctatggcctttcagttcacacaattatgctaaaaagaatgtaaacttaaagagttaaatctaatatttgctttaggaaattttaagtaatttaggaattacatgttatagtcaatcaattttccctgttgctggtactgccaggaagtaccaacacttctttttcctactacttctgtttttgctcaataccagccataggctaatttctagtgagataaacacttagccaaatttagaaataatgtcagatgggtccatgatgatgatcatggtgatgacccactttgcctgtcacaggttgcatggatgcttctgccatgagaaaaaaaaaatacatctagtcctcactttaaaaaagtctgtggccaggagctgtggctcacgtctgtaatcccagcactctgggaggttgaggcgggtggatcacttgaggttaggagtttgagaccagcctggccaacatggcaaaaccccatctctactaaaaattcaaaaattagccagaccaggtggcacatgcctgtaatcccagctactcgggaggctgaagcaggagaatcatttgaatctgggaggtgaaagttgcagtgagctgagatcatgccattgcactccagcctgggtgacacagtgagactctgtctcaaaaaagaaaaaaaaaaaagtttgtttgcacagtgtgacagtgatgatgtggatatggaggtcagaaaactgcgtgaatgcacctgttctaacatcacctcctccgtggagctgctccaaactcagtacacatctcagcactccttctctgaacacccacacactccacccactcctctgtttcatctcttactatattgtattagaatacattgagtgcaagtctgtctctgtcaccatattattcattacttaagagcaagggccttgtcttgcacagccctttccccccaaatgctcagcagagtacaaggcaatgtgtgtctggtatgtatgtgtgaaccaagcactatactagattatttttaaaaggaccttgtagtagaataagtgatccatgatttacacacaaaacaattagagaaaagaacaaattacaagacaacaaagggcaaaattagtaaagtgtgtttcatcagaaatgttactgggaactggggaagagagaaatgagtatgaactatggtttctgtaggtttataatcatttttattggcaggaaagagcagcatttacaaatatatttatataataaatgtgaaaacatttctaaaaatcacataaatatgaatattgtgggggagatgttggggaaaaagggcctgccatcttgattaataaagatgatttgtttaggtctgaaacactttacattttgataatatttataaccataactttattactttatcatctaatacaaagatcaccaaggttctgtttagatatcgtaagcattaaacattaacactggtagtgtcttactactactgaaatcatttgacttcatcaaatttttagttatattggtgccaaaggggcaagctagtgacagagatagcctttattgaccacctatctgacaaatctgtgaccttagaagcacaagaaggtctttctttcacaagctttggtttcacttttaaacatgttgacaaaggaaatttaaccagacagaaaaatgtacttaatgtcagccacaatggcaaggatttgggcagcagttatggctcacttatgtgaaccgttttgaaaaatactttgcccatggtatgtaaaagtcagtgattaaatacgtgctttaaatgcaccttccaattcctctaattttgtgaagagctgagtacactctaatgactgatttagtccctccgactcctgaatatgtattgagatccaaggaccatggcattatgaatctttccctggtcattcagagcaaaataaaacaccagccataatatctgcatgaacagggtatgcctgtcagaggcagaccttaccttcacaaagaggtaaatctcagggttcatgtgagctccctccttttcttccaaaccttcagcatcagaatagcaggaatacttggtggtagagaaggccttactgtgctgaatggtgaagcttgaaggagaaggcagatcttccttcatcacactcccattctcctggagttctgctgcgcagagttgctggtcctgggttgatgaatataacccttccattgagatgcccctgtcctcctggggctcacctggatgagcctcctggagttcagagtatatctcatcaggcaggaggtagcctctgtcttctgactggacagaggccaagctggtctcttcacccttaatggtatagactgacacaaaatcatactcatgggtattcagctgagtggcatataaatcattttctggccttaagtactcatggacatcatcataatggggactttcattttcttctggctggtctggaacctcatacgtcctctcattttggattgtgtcatagatggtgctgtagtcttcgtcattcatgcttattgatccgagagatctgtttacagggagacctgagtagatctgaaatgaatgaagggacagaggatgctgcaccaccttgcagaggaatcaacgagctctt

SEQ ID NO: 199 - DNA, 104249 bp, Homo sapiens
gtcatttcatactgaaattttattttcaggattttaaagggcagaatgttagtttcaatacagcagaaatgcaatttgtaaatatatacttctattgatgttggtgttccccttcttgtttgtctccagggctgaacatcgtcactatgctaggcaaggatcccagtgagcaaggaaaggcctgcagatgcctctcccaacgaagacctgtgcaccctgggccttggctgctgagctggtcatttcttcacacattggcttgactttgggagatgagaactaggagggggccagacaatgaatgttcaagccaaactctcatggagagcctgggccagagcaactctgcttccagggatggagataaacctgaaagcgagccacgcaagaggagagtgagcatgaaagcagcaagggggtaaggatgcacacggagatctgacgttcgcagggacttccatgctcatgttctgaatttgctctttcatatgaaaacagttagctcccacagcccagattaagttttggcatccgaagccaaactggaggcctgacttggcttccccttcgctctttgtgaactttagaggtttgccaggtttctgggatctgataagctggatcagcagaaatccaaagagataggggccaagggctggcctttgttctttcattggccatcttctttttgatctccagcttctctgggttaaccacccactgaattttctccaaggacagggcttcactgagtaatttaaggcaggtgggaattgaggaaatcacaggatgaagcccaaggcttgggagattcatttgtttgctttgttcaacaaatggtttttgagtggtagtgaatacatgtttgagcaagagaaaaggaaagaaggagggaaagaagaaaggaaaagaaggcaagaaggaatacaatccacttctgttcttctaggcatgagaaaaatgaattccaaaaagattaaatgatgtgcctcagctcatgctgctagttggcagcaaatacaggaccggaactcgggtctcctgatctttgcattgtatcactctgacacagtgtgactgagctggaattatatcatccctttcagtggtacttgttcctaaggagaagaagaataaaggatgatgggtggggcatgcagtagttaataacttcaaagagacatagattggctggacctacaagtgactattggcttggccccaaatccaaaatgttcttttctaaataggttgtatttgcccactccatttttatgcatgattccctctcagtcttcagctctaaggcatacggaaacaccagtgtacacacaactgagtgacttcagctcaagctggtacatgctctggttggagaggagatagcatttttgactcgggacttgagctgaaaaataataggcatatactcagctgacagatgattgaatctgagtcttctcagtgaagcatagaaataaactggatatcgtaaagacttacaccaggtgatcaaatgatcaatcaatgagtatttattgaatggccactgtgtgcccaccatcacactttaaaaagttcctttcctcacagagtttgctgtctggctgagacagtaagatataagcatgcgtaaaatagagcacagtatggctatctgatactaggctgacgagggtcaggaaagaatgggggaagaagtgctcattgacagagcttagggggatacaactactgtcttcaaatgaggtgaaggcaagcaaagctgttctctgttactctagagaaaaaatggatagcagggaggcatgcttgggctcattgtaaagaacaatgatttaataatcagagctatctaacatggtagggctggctcattaagcagagggctcctcgttctcagaggctgcagtcacagcttcacagaagcctgtcacagaaacagcagaaagtggtccaggttgaagtgggagattgttttggatgacctctaaatgtcctttccaactctcagattcccagggtttgttatataggagaggatgacactacatgctgcaaatggttagtaagtgcaatgatagcaagaaagtgacatcacttcttgcaacctccacctcttcatttgatagatgaggaaaataatgtgggctcaccttaggaagttgctggaggaagtgagaaggtgggtctgtgcacaaagaaaaaatgcatatgagggcacatttaatagagctgtaggggtgtagccagggaaatcctatgaggaagaggcctttggagtgatatgactgtatacaacaacgataattgcgactattacacatattaagcccccacaatatgccaagcactttcacgctgtatttactcttccaccaacacttgaagtaagcaatatatgcctattttataaatgaaaactgaagctcaaggaggccacacagccaacaagcagcagagggtgaccttgggtccttattacctgacttcagggtccaggttcttgaccaacaggtggtactgtccttgactcatccacacaggtgacctgggcctaagatggagctggatcttgcaggcccctgtgggtagagctctcttaccttgaccacatggagcttgggcaacagattgcagtcagccagggtcagctcatccccatccaggaacttgcgccgggaccccttgtcttccccacaagtgttggcgtcaatctcctctggtagaggggtgttcaggtagtcatccaatttctttagagccttggttaggcctctttcaagagctggcatgaaagagtaaaagggcctttattcaaacttcttgccagtggatacagtcatagggtcttcagagtggagtagctcatctagaatcctgtccccttcatcacactgccagctccccacacactgcagaatacctggaaaccattaacacaatgcagtagaagtgtactaaataggctgaaaaggcaaactctaaccaaacaataaacactagctaatcttttgctttgaaaaaaatacataaatatagaaacacagtctgggtgtggtggctcacacctgtaaccccagcactttgggaggccgaggcgggcagatcatgacgttaagagatcgaaaccaccctagccaatatggtgaaactccgtctctactaaaactacaaaaattagctgggcatggtggcacgcgcctgtagtcccagctactcgggaggctgaggcaagagaatcgcttgaacccaggaggcagaggttgcagtaagtgaaataatactagccaatttatttatttatttgtttgtttatttatttttgagacagagtctcactctgtcactaagctggagtgcagtggcgtgatctgggctcactgcaacctccgactccctggttcaaacgattttcctgcctcagcctctcgagtagctgggattacaggcacaagccaccacacccagctaatttttgtatttttagtagagacggagtttcaccatattggccaatatggtctcgatctcctgacctcatgatcggcccgccttggcctcccaaagtgctgggattacaggtgagagccaccatgcctggccaatactagccatttttttaaaaagttttggttatctataatttgctaatattccacatcaacctacatattacatttttaggaagaaaaggctattaaatgggtaaatataaactatatagaagttccaagacaaagatatgcatcagatattgtggaagtattaactatagctaacccaacccaagaagagttggggacaaggccttcagggggacttgacagggggaatagaacagccctttttgatgtcacccccagagaagtgatgggtaccagggaagaacacttgggttactctagggaagcttgttctaaaaatcactgctgtctcaaatggaagggctccaccacaaatgtgcaacccccagctgcacagaaagctgtcatgattatgactcaaggaatgaacacccaaaggaacataacatgggagaaggcttttacagtcttggtcaaataattatctgtcacataatttatttagacacaaaagcagacaaaatacccaaaagaacaactgtgggaagccatcatcactgaaaatcgttttgcccagaatctcgtagtcctttctaatcagagaacactaccatagaaactttctacttgagctcaaaggacaaacatggaggagatggctgaccagggcatcagtcactgcacctgtgtcatcagccccatccccagactctggtttagagcctgacactgagataatggaagtcgatcctgctgttcattccagtagatacaaggcggacactgccttctggaggcaaagccaagagggctgtactcttgttcagattttcccaagtgtgccttgttagccactcctctcataacccactttttgtcttttcatagaaggccttttgtttgagacaatggaaagacaccagcccaagataaatcaattgaacacttactggaatgtttgaaaactgcctggaggttgggcatagtttctcaatactttcttctccctggtgtggcatttgaactacttcatcatctgctttgtgtttccagtttgggagaacagagtaagcagggctgggaaaatgcagtatattccttaataattgtctagactgtgatgggattgcaaggctattcaaaggcaatggcagagggtgggtactaaacaatgcttattatgcttttctccctgaagcacttgtgatttatttgtttgcttgctcaatccctctacccctttcattcctggagattacagcaaaatcttgattataatgaagaaaggaagaatcaaatactgggcctgtcaaaatttgaccaactaatatcatctgagggaaagagtcatacgataggagatgagacattgcaggttctaatctcaaatggccctggagacctgagtgggctgttgcacaagtctgtgcccatgtcaccaggtctgggaaatatcatgaaatttggtgaaaagcctagagcagtgattgaagttccttgggaagatagttctttatatccctccggtaattcctcgagatggaaggcatcaagtctggtgacaggaatcattgttgattcatgttgcaactgtgacattccatggagctttccaagtcagcacattctggaaggcaccctctgtgtatcagtctcctcacttgggtttgtgtatttttgaccaggaatgtgagggctgcagttggtaacagccgtggtagaggaagaggagacaaggcaacagggaaaggactgcaaggcctgggactaaactgtgtttaaatctcaaggccgcccagggtgaattcactgggaagctgctgagccttaagcttcaaggtgtcttgctttcctgggtcccttccaagcgcttggatctgatttcaagaattctgtattggtacttattgtattgccttaaggcttcataaatcccacaaatgtcgttgatcctggcacttacatgtgaccttggacaagttcctctacttcactgagtttctgctttctcatctcaataacgggactaaggatccttcaccctgttaagaccactgctggggttaactcagataatgcagggaaagcacctaatacagtgcctggccaatacgaggacatcaattaatggtagttgttgctattgccttaccaaacgtggggtcctcctgttctctgttccttgccccatactcttggtcaatatattcctgaatatcccaaggtgcagtggagaatgggtgattttaagaagctccaaatttgtggccaactccctggagaggaaaatcaatagcctggagatttgcttcccttacttatttagtatacagccaaagccctgttccttatactcccttgggatgctccttggtgataagctgtgttgaaaggcacacccatagcaaaatagacacaacatgcctgtgtgctgaaacactaccatattatcggatagcaaatggcagtacccactatacgctctgccaattcttttcctcccacctgccaactcattcctctgaccctggctcaatctgccatccatagaatttaatgatctcttttgactgatggtacacaggtcatgaaactatttgaactttctgctctggtaggaacaagggggatgtgaaagaaactagagcaacaaaaagatgttaattctttgtgtttaattcctcgtaaatatttgatatcctcactccacataattactctgagtagttagatgggggtatccctccaactacagcaagtgagcctagggttggggcacccaagacgcaggatcactaacatcccagggacttgatagatacccagtgttttaactgctttcttcccctctccgcctctgctccccatacagatttattctgtaccacacacaaatgcactgggtaaaatatgtgatgaggaaacaaggggaatagttcataaatattctgagccatatgcaaacaatcttagatttatttttctcttttttaaggaggaaaaaaaatccacccattccatgatcacttccagattcattgaggttgatattacataagacccaatattgttttctcgtcgtagagaaataatgacttggaaacagcaatttgagctaagaaaataatatattcttaccagggcatggaggctgaatggggactggggagccaagactctaacccagcctccaacaagttcttgcaagaacagctcagccctggtttgctggcaaactcagtgcagcacaggtcctgatgagcataaggcaaagcagactcctggggctcaaaattcacatggagaggagcagatatcaaaggtggtctttgaaagaatgagaacagctctgtgggcccaggtggctgcacgctcaacttctcatatatggtttttctcttgtatgtgtgttgcagcaaaataaaaaccaggaacccacctgtgaccgttgtctgtagattggatgggtgtctgttcaactctccatggagaaggaggttgtggttattgggcactggcctgggccgagtaccctctgccctatcttgttccttttattgccctagtcccataccttagcaccagcaaggaaatacactcactgaattcccgcagtgagctagggatgtttatgcaactaccatttaaacacacaatgaggctattgagatggaaaatattattcatcgtcattcaacagatgaagaaactgagtcttagacttacccagggcacatacgcttatgcaagcacacacatagctggtccttaaaccattcaaactactcctgggacgtacaatggaaatgtgccttgctttgttttcaactgctatggtcttccttacaagctcctaacctctgggtggtggaaaaacaacaacaactttaatttcgtccattttggattataacctagtctgatgtaatcatctaaatagtccccctagagaattctgtctctttgcattgatatgctcagtttcccagagaacctgcccctccttgctctccttcctgagtcagtggcactgggaattggggactaggcccctgtgacctcacagcactggggagatggggtttctggaatctatgggtggaaggctttggaaagcgaatacaggttctgcatttcttctgtttgcttccttccagagtaaccatggggatgctgggtgggggttacaggtgggctgcttgcctccctccacaatctggaaggatacccaagcaaagcaccacacggagctcttaacatgctctagttccctgaccctcccccccaccacctctcctttcttcttcatccccaactcccctgtgctaggaagggtgggcttttcttttagttttcccaggtcaaatggcccaccaatcattgagcagaaagcctcgcggccttgctgcatagccagtacaactgtttctactctgtgagtcgaggcctccaggcagggtttttgatgggtaaaaattgagaaataaaagagtttagaacatcttagacaataggttgggtaaaagtctactgtcttgttgaaaatgctattttgaagatcaaaagctgaatattgaattcttttttctgtcttagagttccttttacagaaatcctaatctctctgaggtcaatgaatgcctagggcagattagaatcacgtactcagagtgacagagagaaaaaaatgttcaatcgattagctctattataatttaggtgcaaagcccaggatttaagcgcagggctattagattctaaaacataaactccttctactctgcaaggccacttctgggtgcaaggactgtcccatcactccttgggtattcacgtggcctgacaggtgctgcaaaatgttctcattcccctgacaaaagaggatggggttcccctcatgactcccccatgccttaccttccaactaatttggtaacatatttgtgttctgctaccagtgcttgatttcagatataattcttagtactttcagcgaccgtgatgaggtcaagaaggagttttctctgagtagaggggcaaccatgacccatcacatcacttttcaactctgcctgtactaggggccagtgctgtcacacgggctgtgtgacaatgaaacatctggtcaaaaagtgagaaatccatttggatttttcctaggaggaaagaaatatctagatattgagaaatacctggagcactgaatgaagtttttacttttcatcttctcatttgagatcatgttgatataaccaaagggtgcaaaaaaagtacagtggtggtttgagaaagaccatggcagacggagatgtctctggccatcacatatttttgaagagaaaatacaaagatggccacacttgttgacatttgatagtttaaaacgtgaatggtaacgtgatggaaacaaaaaataataataagaagaatatcaccacttactcatctgttggaagaagaagcctttctttccacaggcagctaggacaagaggaagagacactgagagagatcagatggactaggccaaagatccaggagcaagcgggatgtaggagccccagcagggcccaggaggattgggagggtgaggaaaagggcaggtgcaggccaagcaggcagaaatgtagatgctgctataacgagctcaattttgaggagaggcaaagatattctaaggggattttgaggatgttcagctctgtgatgggcagtgtaaccaatcccctcccccaccagaaaactttacataaagatctgcattcatctttcaggttttagaaatgagtcatgtagcttttttctcagttgccaaagtccttaaagaaagagaacagtagcccagttacagttaggttatatgagtatgaatgaccacacaaaggcaaaattataaagcaggtggaaactggggttttctcatccgcagtgacctttctaggactcatggcaggtaagggggggctgattttcaggtccctttgtcttttaaataatgtctacaccagattcttagaccacatgaagtcagaaatggcagcaaggttttagaagatgggaaggggactttctatcaggtctgatgggacgctctctgctgtgcctgggccctctggctatgtttgcatgtcactggtttcatcaaggaagaaacagagaatctgggtcgagtatgtcggggagccatggcttctgataacaaacacagtagcagagcagcacattcactctgccataagagatttgggtttgaatcctcagttatgcttgttcacaggttcacatcatctagtgtctggtgcagagtgagacttgattaaagttaactgctattattattattacagctatagaacttgggtttatgagaggatgaaggggaagaagacaccgagagaaagatgagagaagagatagctcaaggcagaaattcagtgtctgaagtgaagtttatctgaacatcctagcatgttccaggtccaaggagaatcctggagagcttgcaggatgaagcttgctcttgactttcctaacatgttagggatctaaagttgcctggaagcatctctttgggtttggctttgctctctccaggccacatgggtgtgtcacattttcttagtttgacagtttagagagttcatgtccacctttggcactgaaccaagaacactggacttggcctcatagccagagaggaggatgttgtcaaattggccctgggtgtgaacaacccaggggctcacatgggggaggcaattcccaggcctccgtttctaggcactgctaaaaacaggaaaggcagaaagacaaacagcggtttatgagaaagcaaaatgcaatggcaacttcaacagattccccactgttccctcgtgtggcgtcagctgggctacagagagtgtgcagcacgtggtgccatgggtattatttgtttgttctagaaagaatttcagcctcagaggggaggatgaattaaatgacaagctcctatagttctttccagtaagaagccagtaaatgattctttatttgaaagatagcgtttaagtcttacaattatggtgggttgggatataggacactgttggttgcccaccctcctctgtggtggggagaatggggtgttttctgatgtatttccaaggaattcagaaactttcttaaggaagacacagattctccacatagctgcttccccaagctctataggggattcttataaagaagcatctttttatttaatacagctccacaaatcacccttatatttggcgtatgttcagaagtattagtacaacaacaaaatgcatattttttttaaaggcaagagactttggccagtatttggctatgtttaaaacaccagcatggtaaacatttaggacaactttagcatgcctttagtataatattttcttaaagtatgaagggaggtagggactccagatccaaataattttctaaacctcttaaaagccacagtagatttgaagagaaagattatcacttaggtcttcgaattaagtttccttttgtgtactcatctgtagcatgtaagctgcctgaatgtttatttatcaacaggagaagggaggaagagagagagagagaaagagagagagatagagagagagagagagagagagactgactgaatgtgggaggaagctgcagagctagcgagctcaggagtgatcaggggagaagttctggttagggaacccggcccagactttagccatggggcagtggcgacaccttctggcttatccctgagcaaacaaacaaacaaacaaaaaactccccaaaaacctattgtgtattttccacagagaacatgtacgtgtgttttctattagactttccagaaactcataaatgattgtagaacccatcgtgctaatagaaagtacggcataaatgctgacggaagctattaatgctgattgtagtttatgtggccaaatgaatcaggctgaaatctgtgagtttttttatggttactttataacaggttatttttaagtatcaggccatagattaggtttaatgcggatgctcacacacttagaatgagctggttaagagagattctaactttatcagtcatccgttccagcgtttagacctagagatttttctcaattctccctcccccaaaacacttaggctgaagtacattcaccacattttgtcttgtttcatcctcaaatagccacatcttttacataagagccattcacaaacttaaaaactgcctctgtgccactgcaatgctagactgaaataattactggatttggtgattctgtgaatatcctacaaattctcttccagttgcccattcttttatttgttaaacaggcatctattcggtgcccactgtgggccaactttgtgcccctttccccacatggattgctgggtgaggaccctgatggggaaggtgggaagtgttgagtatatttaaggaaatacacatggtagtcattcattgagtattcatcggatcgtgaactgatttgatcaccatttcctaaatgacacactcttgtttaattcagcactacatacatattaaatagtggattatattaaatgttaatatacgcaagtcaagagcacagatcatgggaccagctgcctgggctggggtcctgaccctgacacatactagcttgggcaggttgcttaaccggtgcttgtttccttctctgcaaagtggagatcataacatggcataccttagagggttgctgggagcaataattgagtcatcacctgcagagggcttagtacagtgcccggcatgctgtaagcagttgttatgtacaatgtgtatgtgcaacgcatgatgatgctgatgtatgagaaacaaagcatacaaaaaaagcaacaaaaaattcttagagctgcaagaaaaaagtggctcttgcctctggctctgctcagtaaacatcgtgcttgactcatcctctgccctgaaatgctgacatgaacagggatattcagctgttcctttcattctgactctacagccagaaccacagtcccccagccgaaagccttcatcataacagatgtgaaatggggcaaccttaaaggttgggggtgactgatacttacacagaattccccagatatgctacaagtacacctggacctccctcccccttgctcagagcagttccctggataccctaatgtgccccagcaaaaattacagtttgtggggagaagctacccattggatgtttgagttgcacagcttttactacatgagtcttgcatctcctaaagtttgaagtgtgtagcaaattaaatgtgcaattttatacttctgtttcctgaaatctagtagggggtaaatgactcagatttttccagcaccaaaggagaatttaaaatagtgtgtcctttttggcaatggctaggacaggtattttcaccagagagagaaaaaatatcaccttaacttgaaagtgaatatataagaattgaatatacaagaattcagtctccttttatttgttactagtagaagacagagcccatatatatatatattttcagggtagcaatgtgccctatcaaaaatactcatcttcctagattcccagaatttcagctacagaaggccaaataaccaagttctggctaaagagatatcggtagaaattaatcaatgggcttctgggaaagataagatagatgcggctggcattgtctggaatgcggatgtgatgtttgggggtggagcaaccatcctgtgaaacaagaatgaaagtcacacacgaaagatggagaattaggagctctaagcagcagctcaattctcgacttctttcagcaactacatttgcctggaactctctactctctggacttcttgtcatgtgagaaaagcaaattcctcttaagaagtaaacatttatcaagagtgcttagaacagggcatggttcatagtaaaatgctatataggttttgctaataaaatacatgtttgctttagccactgtagtcaggcttctattacaaacagccaaacacaacatttgccaatatacataggtattgccaacatgccaacatgtcattattccgctttttttttttttttttgagatagagtctcgctctgtcacccaggctggaatgcaatggtgcgatctcagctcactgcaaactccatctccctggctcaagcaattcttctgcctcagcctcccaagtagctgggactacaggcgcgtgccaccacgcctggctaatttttgtatttttagtagagactgggtttcaccatattggccaggctggtcttgaactcctgacctcgtgatccgcctgccctggcctcccaaagtgctgagattacaggcatgagccgtcgcgctcagcctcattatttcacttttattctagcaccttgcacagcgtatggtactgaataagtatttgttgaaagaataagccgttcagtggggtttgaggaaagatgaaggaccctaaaatcatgtgactctatttatatacttatgtaataagctttaactctgtagaggaacaacagttccctttctttgtataatagtagcccttggtcttttgaggatagatgaagggattcaattagtttggcctgagataccctcccacagagtcccagccactttgttatcagagccaagagagaagcataggttagcatcaacctctctgccaaacgactcaggtaggactgaggcagtttcagacctgggcaaaatgttgagtaaaactcatcttagggtccccacaatggaaacagaacatggataactatcattgcaaacatcagtgggcatgagaccatcagagttagagctgagtgcaggaggtctgagaaatcacgtggctcaaccctcccctccccagaatgttctggaagggaagaggttctagacactagcacagagaaacatatatacacacacacacatacacacacacacacacatatatacatacatatacatatatatatatatattttattttttttattttttttgaaatggagtctcgctctgtcacccaggctggagtgcagtggtgtgatctcggctcactgcaagctccacctcctgggttcatggcattctcctgcctcagcctcccgagtagctgggactacaggcacccgccaccacacccggctaaattttttttttttttgtatttttagtagagatggggtttcaccatattggccaggctggtcttgaactcctgaccttgtgatccgcccccctcggcttcccaaagtgctgggattataggcatgagccaccgcgcccggccagagaaacgtattttatttaccttgatccagatcattaaatgctttgtccaccaggggtcttagaaaaataatttgacctctggctgctagctgaaaaaagtctagaatttagccttctgtgttttctcttttgactcttggtgaagtatcacttttaacaccaaatagaatttcccttgaatgtggttataaaaataatggtgaaaagaaaaatcccacttcagcgaagcccgccagcacactggccatcctagtgaggagagctgctcaggttcttgcattcttttattgattggttctaagtgagattattcaccatgaagcttgatatcatataacagaggctacaaaagcattgtatgttctcacgtcaaagacaatgctagtcacagaacatcataggatttaaatggggactgggaagttttaaataaatacagtcagagcataggggagtctgcaacatggggacagatttaaaaggtgaggttccacagcggggacaggaagtggctggaggacgtgcccgtggctctgatgaggccccgtcatcatctcccaagcaaaggcatagacaaggtagaggtgtgttgaagtgtttgtatacttttttttctctcatttaacaaatattgatggaccatctgccctgggtcagatgctgagctggggtctggggtgacaatgatgaaggaggcacacccagcatgcttcctcacagagacagctgctcagaaccctgtttctcacagcacagccctggaccaacagtgtccgaatcgcctgggagctctcaggccttgccccagatccactacctcaatatctgcttcgtaacaagaccctgtgggaaaccaggatatgccacccccaaaataggaaggattgttgagatgaagacaattcagaagaaacagaggcagtaaagctctctgccctccctctatttgtctaaaagcaggacgtagatttacaaagacaaaacgtatcttgcctccccccttctaccagggagaaccactgaaaacaacttaagacgcttatgctcctggagatggccctgcaggaatctacattgaacaagctttgctaactggcctttatctgccattcatttgctatcccccgaagttgctgcccctagagactcaaagtgttttttcccttgtcacatctctaaaagtttactgtcctttgatgaggatgctgtgaaactagaattcaaagccatctctttgagaactcctcattatagaaaatatacatgttaataaacttctgcttgtttttctcttgttaatctgtcttttgttacaggggtcccttccaactaagaacctatgggggttattcttcctctaaaacccccacgggattcaaatgtattcgcaaggtagaaaatggtctggctaacaagaggaatgaaaagaagtgctgctttatgcttaagccttaagtctgtgcctgtcttaactcatgaggctactccggctcagcctggaaacaagcttgagatggggtggagtgccttcctgcaagacggcgctggagcaggatttgaaagaaagcctggggttttaaagccaaagttccatgtagcaactttttcccaacaaattaccctctctaaactgctgataaagtcagaataccagactagatttaatccctggttttagttcttatgtctttgcaacactagttggtagcaaaagatgtttaaaagctgagaaatgctgaagcttttgctagaaggttcagtgcaccacctggatttcacatcttgtcattttcagccccagctctaccaaaaatgagggaatctgttctacaggttaacttatccagagatattctcccctaaaggtcagcagaaacttggaaaaagtttcctcaaagctacgtcctaaccacagacaaggggttatgaatgtagtaattgtataaaccaactgtgatactttcaacctacacacacacaatgaaatgtagacacacacacccatggacacactattgtacttctgtggtctgcatatcctgtgcttagtgggatattgtgtcccatcatgaatatattgtgtcccatcatgaatataattttgcatgtaagcactttcttttagattaattgaaatgagcctgtctaaggaggtatgtgatggcctttgccagtacataagaacatcagaacacacacgaagtgcataagtgtgtgtgtgtgtgtgtgtgtgtgtgtagagagagagagattgagaaacgtatttggttcctatgtgtagactgcacaaagacaagaggtgttggttgcataggatgaggtaacggtaggaagaggtgaaagaacatttaactcatgtgcaaatcagttatttaacgttcctttattccccaggtcttgatctgcatccaggccaggccaggagaactcattctggtcagacagcgggaaattccaccacatggaatggtgttggtggtctccgctctactccagtccaggagcccacacagcaaaattccactaatgaatgcgcccacccacgcagggcccagctctccccacccccttctccccatgcctgccccattcaacaggccacgccaccaccaaccgccttccttacaactgcccaaggattcgtttcaggagcaagatttgttaaattataaattggaagcatccacctcaataatgaaccaaatcaaagaccctctggaggaatccctcaggcagctcatgggagggaccagaggaagcatttgcccactcctctccctcctgccctcagccccaaggaccctccatgagggaggagacgaggacatgcaagtgcagagcccaccagacctccgaggtgggtcccaccgagcctaggttatttgtttttccttacaagaatgctagtcaaagcaaaactttaacccaacaaaccaacaaacaaaatacccctagttggctatttgcacacaggggttgccaaggaaggcagcctgaagggtccctttgtgaccagaggcgtttttgaaaggagacagcaatggctgctttatgaggaagtggtgagacggtcacatgttatccgcattgctgtggaggtcggcctgaccacccaggagccttcaccaagatggcctgataacagcccaccgtggggctcccaggcctctgcagcggtcttcctgggacccaactgtcctccaaaagaactgcttccaacagagtagacatggagccccacggccacctaagtgactctgtttctgagcatgctacagggtaattaggtttcacattcctgctgctttttacacacggccttagctttctcatcaggcctgtggcagagcacaaggcagaatgagaaggggggtgccgcatccatcccctggatggccaggccctccagacagggccactgtgacacgggggctgggggctgggagggaggaaggggagaaggcatgaagcgccttatgattgaagtggcttggaataataaatatacacactcttttttaaacgtggctcaccacatcctgggaatctggaaaaaatgccccacttcactgtccctcaccctcctccccacctaccccccagcagcagtggctttcatgacgcctgggggaaagcacagggcctttgataataaggggcttgttagttctaggctaacagccctcccaggccgctctgaatcctttcaagcacttttttattttaggtcaaggaagttcgtaaatgtaaagactcgagattgtagaaggagaagaggaaagggagaaagaagcatttgggggtagttgtcattgggaggggcagccagggacctcctatggtagatccgtcaggcctggtggacatgcccttcccttggtgtgggggacagataatggaaggtggctttgagccttgaagaagacctagccttgtttgaaccgtctaagctttggcttagataaaactgaatctttgtataggaagaccctttcgaatccacaggccttgaataaatcacatcagctggctctggcgacgattcctctgcctgccagaagagggcagcacatgcttcctcattacagggaaagctgggctgcccagtccaaagggtggacactaggtatggaggcggggggagcactgtgaaattaatagcagcagcagcaacagcagcagcaatagctatcacatattggtgcctactgtgtgccaggaactgtcctaagtgatttatatgcattaattcatctaattaacatgacaaatcttcaagagagggtgctattacaatctccatattaccgttgaggaggctgaggcatactgaaattaacagaacttgctattgtagccacggactgcctaagattgaggtcagcaaattacagtccaaggactaaatccagttcactgcctactttcatgctgccctcaagctaagtattgttttgtgttttacatttttgcatggttggaaaaaagtcaaaagaagaataatatttcatgaagtgagaatgatgtgaaattcaaatttcagtgtccacgaatgatgttttattggaacacagccctatttatttgtttacatattatctgtggctgctttatgattcctgcagcagaattgagcagagtctggtagaggctatgtagcttgcaaagcctaaactatttactatctgaccctatatagagaaagtttgccaagccctgacttatgaggaagagctacctgtttccaggcaagagggacagagaacagagttgctatttactggaaatggagctagtatcgctatcccagggcaatttagaagcaatgttgaacttgattcactttttttccaacagggcagctcaaggtcaagcaaaaggagggtctgacatgtcactgaatagcctcaaggaagtaataaaaggttagatctggaaaggactgtgaaagtccactattatgtctcaagtctaaggtgcacatttttttcactctttaacatctgtgaaatcaggcaatgtcttacaatcaaaatatgagaggttaagtgaaaacactttgtttaagtgatagcattttgttgttgtttcttagaggtttgtttgtttgtttgtttttgagatggaatcttgctctgtcacccaggctaaagtgcagtggcatgatcttggctcactgcgacctctgcctcccgggtttaagtggttctcctgcctcagcctcccaactagctggaattacaggtgtgcgccaccatgctcggctaatttttttgtagttttagtagagactgggttttgccatttggccaggctgatctcaaactcctgacctcaagtgatctgcccacctcggcctcccaaagtgctgggattataggtgtgtgccactgtgcccagccagtatttaaaataatagtgtcgtacaatcaatgacaccttagattaggcagttcctgcctccaaagatccagcctctttttggtcctttctgttgatgggatactcacttcttttgctggcagtccattctacagatttaattttaaagtttcttttcttttttctttttagacggagtctcattctgtcgccaggctggagtgcagtggcaccatctcggttcactgcaacctacaactccctggttcaagtaattctcctgcctcaacctctcaagtagatgggatataggcacatgcccccacgaccagctaatttttgtatttttagtagagacggggtttcaccatgttggccaggacggtctcaaactcgtgacctcgtgatcggcctgccttggcctcccaaagtgctgggattacaggcgtgagccaccatgcccggcctaattgtaaactttctaatgttgagctgaagtgtgtaagcctaaattttctatacatcaaatgaggatgatcttgcttaatacgtttactttaagagtcttaagatcttattaaaagggagcgaagggaaggaagcactgtgacccccggggtagggaggaccagagccggctgcaggaatcagtctgtcggtgtggtcacaccaggcagtctgcaagatgggaggacagggatgagttgttggggacacaaaccatgaaaacctggaaggaaaagaaagaccgccagtgatacagatgagttctttttctagcagcatcagccaggagcatgacccactgcaggtggcacctcttagaaggagaagacaggagcaatttgaagattcgggcctgaatggaacaagaagacaaggaaagagcgaggaatgcacctgtggctggcttgcccctgctgccttatatgagggctctaggagatgaggaagggaaatgagagaggcaggatgacagtcattgatattgtgttaataagaaccacaatgtcctccttcaatcacgttcccattcagtgggaatgatcatccaaattctgagataaactcactgaggttcctagaataacccgagagtcttcttccattctatgtggcagggacaatcaatttttccagaataagcccagggagcttccaggttccagaaagaggagcctctgatgtgagccttagggaggtggaaaccttggcctttatttggaaacagaaccaagactgctcagggacctgtgtggctaatggccacttttttgttccagcaacaaattgggaaccaggaggtggtgggaactagggtacactccctcgccctctggtaaccacgtttgagcttggattggagagaaaggagaagcagagggcttagccctaaccaggtgcttttcatctggggacatgtgtcctggatttcctgggacagtaccaatttcttataatttgattattttcaatgaaggcaatttgttaggcatctgattttcagtttggaaaacatggccactgcagttacaactgatgaagggcaatgcaatctgagcacatgcccagcacgtcacagataccaaggaaggtttttagggctttctttcggaagttagaagcaccttattaggacaagtattttaggaagagtatgttaggacatctcagagtcttccataaaaagagaactaggtgcagccttgcgagtgaaaggggtacatctttgcacatctagtgcaggagcccattcatcttgatgaaaatagataagcccagacaggctgttctgtgtcccatgtgctgggtggacagagaggggcagggaggttggcgacacacgcctgaggctgcagggaggtctcctgagtcttccagagaagatggagagaaaggaagaaagtgagtttcaggtgaagagagaacacagggattgtgagatcgggaggagcacagctcacaggtgggggaagatggagaggagtcagagcagcaggaagtcagcagggcctggagtctacagcagcctgaaagagaagtcacaggaggggagagccaaagaaaatggaaaccacagctcctccgtgcctgcggctcacagcaggaatatttgttattcttctgggaggctggtttgtttttatcttctaggaggaccgagctgcagctgaccaggggccctgttttgctttgtctgctcacaagtttagagccaaatttgtggtctaccttctgtgtggcgcacgaaggccccggggctgccctgactgttttagctcacccagggctccatttgatggttgtctccttgtttttctttctcacctcctcttggcctttgttggtttgccgtgctttatgcatccctgggagtagctataaagcctttctggaacaagtggagtataaattttaaaatagaaagaaggccccccaagacagaggaatacagaggtggaaataagagagaaaagtggacttgaagggggaagaaaagagggaattcaaaggaagccttgaaagactaaaaccatccagattgggcaaaacaccacttagtgcaggtcgcctgggaggcctgagagagcttaagccccaagactgcatgtgatacagatgagatactattgcccctggggcttttcagacctctcactaggggaaagggagtcctgtggaagtgggctgcgcaaaaggaggttggatggaaggtggtcagcgtgaatagagcaggagaaatactgaatttttgtcttaggctacaggcataggcatgcctacttcctctccagctaaaaagaaaaggggcaaaagcacatgagaatatgacactggcaccaaaaacaaggatggtaattcttggtaggacattaactgtatctgagggaaacatgatagacctggaagaaattttaaaaaggggtaggagacttttcaaattagttaatcaaaatagagcattcaagatgcacattagatccatttgttaattacctgccatatgcgatggggacagaacatgaaataaatcatgtgtattgctaggattgaagcataaggaaagagagattgtggaaaataaagtgaaatatagcactttctgcctagattatgataagtaactaaaatgaatttcttgaaaaccaagagatttgcagggatttttagagtctgttcaaatggcagattgagggtaagaaatgcaaaatgtaagacagatattcagagggagaagtccacatcctcttaggaatgacagagagtgggggacatgttaaagtaggtgtcaaagaaacccctttagggaagagacaaacccaaggagccaaaggggtgttccagtggcaggcggggaggggtgtttcacagcgacgcttgctagaggtggaggcactggcttgcagaaggtggaggcctgggcccttgctgaactccaccatgtgccaggcaggctgggtagagagcatgattaagggggaggacagacctaactgcttgctaattacagggatgctgcaggatgtgccaaaggggcatggatgacactgtgccctccctcaagccttctacttcagcactctatgaacctccaggtctaaacccagggcataacttctccctgcaagattgaaaaagtgaatgtggggctcagaggaggaacccctccagccaaatctaaatgcagtgctgctttctcccatctcaaagatgctctttcgcaggaccacgagcactcttcccatgtgggttcctgatccagttccctatcatcacccactggtcctcccctttctaagggagcagggtttgtgcttcctccatcagactgagctctctctggttgtgtagaatctgagtaatgggtggattccacatgagaaaagcagacagaaaaggatatccaagaacactttcagggagctgcacatagcaggcaaaagtctcccaggaccttctctgcagcattttataacacagatcactcttttaaaacaacaacaacaacaataaagcttgctttcccatctttatgccctccccactacccccgatttcctccatcctccctggctagtccttctttctcttcctccttgactcctctccctctgtcatcccatctatgtgattgatccttgggcatcgtcttaatcatctaaagatgtataacccctcaaactgcatttttataccagaactctctgctaaggtacaattgtctacccgagataactgctcagaacaacggctgactttttttttttttttttttttttttgagatggagtttcactcttgttgcccatgctggagtgcaatgacgtgatctcggctcactgcaacctccgcctcccgggttcaagtgattctcctgcctcggcctcctgagtagctgggattacaggtgcttgtcaccataccctgctaatttttgtatttttagtagagatggggttttgtcatgttggtcaggctggtctcgaactcccaacctccggtcatctgcctgccttggcctcccaaagtgctgggattacaggggtcagacaccatgcctggccccagcagctgactttgaacgtggtagtgggcattattccaagcacacttatgaggtatacacagttattacccccatttcacagatgaggaaactgaggcattacagagttgaagtaacctgtgccatgttacaaggacaagaggcaaagctggtgtctgaactctgaactctaaagtagttggctttagagtctgcaagttgagccatacacagtcacctgcctctctgcataggaaacacagcatgtttagaaacaccgtccttatccttctccccaaaaccaggcgtgtgggtgagagatcttagagcacaagaaaacgaagcaacttccccaagtagcacctgacttaatgtgggatcttgccaccgagtcatgagaaaatccagtctacatttaagtgaagtgaagagcaggttggaaagagtgagaggagggggcatggaggcagtatctggttactgcagaccaaggggacctggatctagaaattacagaggaggggtgagtacagtgataggcctaaacacggagcacagaatcgtccctcagggaacaaaaaaaaatgcaaggctgctgaggtatgagagttgggccaggccactgacgctccttgatgacactttggagaggaggaccatgcaccaacaaagtttaaaaagtagaaaatagactgaatgggtgggagatttggaagagctaactgagggggaagcaagagctgaagcagcagtttctgatgtcattattcatcttagtcccatttttgtgctaatagcaataatcagaataatcaaatttaacagttacgaggccagacactgcgctaagggttttacatgcgctgagttataaaatagatgaacctgcattacaaaccttggtgatattattaattaccttattgccagataaagaaactgaatgtaaagtccattttacagatgcagagccagaggctcagaaagaataagcctcttgggtaaagttgtgcagctagaagtgctgggattcaaacccaggccgggaattgcacatgtacttgttttacagctccctgtagattgttagttcatggagggcaatgactttgtctcgttgccttggcaactccagaacctagcacagtacctggcacataagcagtgccctttaaatattagctcggacttgtagtcactttatataacttgtggttttttgaatgaatcagtgaatgactgaatgtacaaactaatggatgattctctccattactccagtactgctgggatggctcccacggatggggtctcggttgtggtagctggggacttacaaggctttggggaacaacagggaaattttacttggtggttcctgtagccaccacaggagtggagtggagaggtgacccaccatggagaaccatgtaacagtgttggcttttctcatgctttcattttgagagggcagaaaaggatcatgacctgggccagtgtgtgtatgggggctggggcattagtgaccaggtagaggggagggagggctctgctcaagagaaagtaaatgaaaatacaagagaaaccctctaaagaaagaaagttggagaactaggtgcagagctgaagatccagagggaaaaaaatggcaaagtaatgtagggcggcatgtggaaggaggcctgggcctgaatgctgatgctcttggggagaggccacagccatggagctcacacagagcagaaaggggatggaccatctcccgggtcaggggctgtggggctctgggaccgtaacacaggagccatgctgctctctacaggagggcaagccttacaggagccttcacctctggcttgctaagcctaagaattttggacccagttgaccacaactcgggggtattgggtgggaggaaggacaagtaaagaggaagggaggggtgtgggcaagttatagttccagggaaggaatgtgtggtgtcttgttaaacagaaggtggaatagcacatctggggacaggctctttgggaaagcagcaatgttggagctttgaaatgtgcaaatgagttaggggaagcaggagtcacaagggcaagtctcattacagaagaaaacagggtgaaacagaagaaggggaaacaatgaaaattggagagtactgagtttataagaaatggatatgcggcatttggtggaaactggctttggacttgggaataggagaactgtaaatatggataatatgtaaacaccatttataattttaaaaatctggagggctcaaatgagataatctttctgagggcactttgacaagtatgaaagaagatatttgtggctaagaggaaaggatactgggtgtggagtctgaaaacgagggttcgagagccagctctgccttgggggtagacaagtcatgggtcttctcgtttggttctctgtcctcagccgggaaagcagcaatgactcttctttcccacaatggctctgaggggccatattcatttcctaggactgttacaacaaagtaccacaagctgggtggcttaacacaacagagacttttccccttacagttccaatatcaaggtattagtaggtgtccttccttgcctcttccagcttccggaaagctaagagttccctggcttgtgacagcatcaccccagtctctgactgtcttcacatggccttctctcctctacatgtctgtgtcctctcctctcctcttttttttttttttttttttttgagttggagtgtcgctctgttgcccaggcaacagtgtgatctcggctcattgcaaccttcgcctcctgggttcaagtcattctcctgcctcagcctcccaagaagctgggactacaggcatgtgccatcacatctggctaatttttgtatttttagtggagacgggggtctcagactcctgacctcaggtgatccacccaccttggcctcctacagtgctgggatgtagtcaagagccaccacacctggcccctctcctattcttataagaacaacagtcattggatttagggactacactaaatgcaagatgatctcatcgccaaatccttaactaattacagctgcaaagaccctatttccaaatgaggtcacgttctgagatcccaggtggacatacatttaaaaaaatttttttagagacaggaccttgctctttcacccaggttggagtacagtggcataatcatagctcactgcagcttcgacctcccaggttcaagcaatcctcttgtcatggcttcctgaatagctgggactacaggcatacatcaccttgctcagctaattaaaaacaagttttttttttttttgtaaagacagggtcttactatgttgcccaggctagacatgaattctggggggacactactcaacacactatagggttcaagcagcaatgaagcaagagcaccaagtagattgaaagtactttccacatgcttcttcttatttcccagaagccactctctttctagtttcttgacacacacctctaatggatgtcattgcccacaagataaaaacccaagccctccaagctggcactgtgggcttcagtcactttttccagtctctgtccctgactttttctcaacttccccgcatcttctgctcaatgatctcagccaactgcttccttcttaatctttatgacccagttgaaactcccagaaaaggagtctcatgcatttacccccatggtaaatgcttctggttctgaataccttcgacagaaattattttgttcttttacctgcagttaatcagctctccagaccctcttggatcaaactgacttgaagcctgtccttctgcatctgccaggcattgaagactgaggaagtgtttgtttcttctttggacctccagaaccaagttttgcacttgtcacaatctgggtcctgagtagcttcctgaattatttacttcccgatacaccaactctgttcctgccatgatttcgtctcttttaccatgcatagctgcatatgctggtcgccttgatccaaagagatgctattctccttggagcttctggggcatctagcatctattcccttgttttggtccattgtgcatcagtcacttgttcattcacaaagattcatggagcacttaagttgcttggctttgtgctggactccagtcatccagcctgtgaggctgtcctgtcatcccattctgagggcaagggaatggctgccattgcccataggataaaaatccaagccccccaggttggcactgcagtggctagcctgttcctcctgggcctaacaccgttcttcaagtgttatacctgcttaattggacggttccattcaaatggctttaggtaattcttaaagggcaatgccaaatgaaggactgaaagtgctgtgagcataactgggggggactcagctccctttcagaaggccccgcaagagaaccaagtcctgaattctgtagccaatgtcagaaatgaagggcctgatgtaggatgggccaggctttgaggagtggctttccagggcccactgtcctgcagaaggggagaacacagcccaggtctgccttccacatttgccacagtagtgactgtgctgcctctcccttggcctctggaaaaatccctggagaaaccttgtagggaccagaaggaagcgggaatatgttgctctaatgtgatcacaggcagggttgggaacttgggacaaatgggcagtgaggaccgttccgtgcagtgcactatgctgtgcaataaggcaggctcagatgacaaagagcatccctctctccagcttggcagtaaagccccaagcctttcctcctgcaccagctaggcagcagcatccaccacctcctcccctgtgtcaagggggacaagatggtggtggcggggggtgggggcaaataataagcagtattggttccagatgcttctctggcccaagtatttgacatgcctatgggcaaattgaagatgccttgggcagcagatagaccactgccaagggttcttggtggaagggagtcactcaccagcattgttctgctgcttggtatttttgatgtaggcagaaaacttggaaaagatgtcgatgcccgctgtgttggattcccggtgttttgcagccagtttggggtacctggaatggaggatgcagtgttctgtgaatcagtagacttggagctcctttaagggtgagcctatccctatcatgataagcaatacttccctttccagctgcatctacaaaatgttttgggggtctttatcctcatactatagggagggtgggcattctcagccctagggcatccatagaagaaaccagaggccagtgaggtgctgagatctgcctagggtgacacagtctgctaggcaaagaaccagaatgccattcaggggtctcaggatgtgtccttttcttgggaccaccaataaggatgtgccagtgggatggcgcaatcaaagttccctctgagcttgcctctctatctggtagggttctcaacacttcccttacccgctaaaataaccatctactgccagtcctgtgattataatcctagctacacagagctaattctgggagcaaggagaagccaggtatgttagcattaaaccatttctccaaaggaagaatacccacggtcctcttctgaaatgcccttacatgcttattatttgtgtgcagtaataacatgcagaaactaccaagctccaaaaaaggacatgtgttttcaattgttttattttattttatttggagatacatttgcaatgatccagcccccctctctctctctttcgtagagtctttcattttgaagccacaataatacaagaggcaggctggagttagaacgattggccttgagactgaaggaggtaaacttgctcatgtgggaacccagggcttggactcattagccccatcaaaatgaaaaaaatcaactcaaataaatattatttcataagcattttatgggtatggccaggtagtggtgggaagagatgggagacagtcgccaggctatcattattttcaatgaatgtgcacctctgtgatctctgggtgaatcgtttttgactgtgggctggtgggttgccttacgtttaaaaagcaaaatcctttttgtttgttttgatgtttttgatagttcgaaccaaacaagactttaaaaaatatttgttgttctttaatgcttttttgttactcaactggcccatgagctaggattccttttggggccccttttggggccatgttaggtggctgtgtaatttcagagatactgccattggaagagtccagctctctgctgtgaggcagataaggaaggcattattgtcctccttttacatggaagggaactggatacctgagaagataaatgttgatggctaataaatggtggagggacgatgagaacctggtttcctggccctacagcagtgtccttccccctccactgcttctctggaaacagtgaaaggtaatttgcattgagcacctactgtgcagcaggcaggcactgttctattccctttacacgtattcaccatttactcctcagaacaactctattggtactattattagcctaatttcctacatgaggaaacggtggcatagagaggttaagcaatttgcctgaggtcacatggctgcctggcagagccaggatcccaacccaggcagtttcactgtggaagactaggttttaaattccacattgtgtggcttctcataaactccgctgttgattctcaaagccccagaaccttaaaggctgagctgcccaccttggaggagctgtctccatccatcaggagggggtgctttgcaccgatgctccacacacatgtcttcctgggtatactgagaatcaccacattcatctgctgtggctgggggcacacagcagggcttcctgcaagatactaggtaatctaccaagacacaggaattcagtgtcatctctttctattttggccttctcacatagaatccagcatgctattagaatcgatagacttaaattgctattaacaaatgccaagtgttctttgtttctccttgataatgtaaagacagaaaggcctagaaaatgcacctcagtggacagcttgtttgggtttcttgctttgttttgctgtatctcatcaattggtcagactttcagtcatctgatcatttcttcacaatcaggttgggccaaacagggatgtgtggtaccaaatccaagatgatgacagaggatcgtgtattcagggggctgtggtggtgtcatcctgtttcccaagcactaggactcgttgtgattttactgtgtagtgcagtgttccatttgagctttgttcttgtgggaagtgcgtctctaagatgttaatctcgcaactttcagtaactacactgggggaggatactatataggataagtgcattcattttacctccatatttatggcgtgttttaaatatgcaaataagcgggctacaaagtacattctgtttctctaaaaggctaaggaagagtgtttcactcacagaaacagctttgaaataacattggatgtgatctgatgataatcaaagagatgataattttttctaactcaggagtcagcaaactgtgacccatgacccctatttgtctgaggttctcaagctaacaatggttttcacatttttaaatgcttgaaaaaaatcaaaaggaggatactgttttgtgatacgtgaaaataatatgaaattcaaatttcagtgttcataagtaaaatattattgaaacagcaatgcccattcatttacatactagtttatggcttctttcacagtgtcactgtggaattgtgacagacactgaagggcccacaaagccaaaaatacatgactatctgaccttttacagataaagctgctaactcctgatctaactgatgaaaatttctctccacccggtttttaggatatcttatttcaaatgcatgcacttaactttcattctgggaagtaaaacagttggcttctcaccaaaaaaaaaaaaaaaaaaaaaaaaatttttcaaaagtagaaaatagtagcaaaaaaagagaaaaccattgcagatggtaagtgccctatctggtttagagtcccagctgacttctcactgactagccacagccaaccaagacactgaacaaaaggatacccaccatgcaattaaaccaatgtgcatgaaacacctactgaggactaggccctgagattggttttggggatagataccctggagaaaaagaaagacggtcctgatggaatggccttgctgatggcagcttaagtgttttccctcctttttctcacgagctgaaaagtggaaagacttcctctctctctcccttctccattgttcccacttccttacttcatcaacccctcacacgtgaaggacgttaatgcatctgacttttctaatccttgactgtgtgcttgtttgactcatgtctgctgtgtaagcaaaagatctctggaggtggaagaggcctggcttattcattaaaagatatcccctaggatctggggatttaagacctaaggtcaccaattgtctgtacaattgcacctgggagacagacccaaaacaggcactggccactctttctaactccttgagcttccatttaatgagctcttacttcatatcaggctctaggctcattagtattattttttacaatagccctataagatcaacagtatggttcttgttttaaagatgtgagaattaaagattctagagaattcaggtcatttgcctgtagcggagaatatgcatactcactaaatagccatgtaattctgtttcccagcttctctctcacctaagttgggatcacgtgtggattctgaccaatggcataggaaggaaagtaatgtcaccatgacattttttttgcaggcctggccctgcaaaacactttgggagatctttcttctctctctccctgaaggagccttggagggcatgtattccaaaaactacaggatggaagagggccaccctaccctctcagaatttgctcaagtgagaaataaacctgtgttctgttaagcaactggaattttatggccgctttgttactgcaacatagcacaacctagtggtatggatttgaacccgagtcactctgactccaaacctcctgcccccagctaccatgccatcctgtgggaggtctggaggctgtttctctacctcccagagggtcagaactttcttgttttttactgtggtgagttatcgctatacattttgtaaaataatgaattcaagttgtcttccaattctgtcagtgttctgaaccctgttgatacttaaatcattcttgctagatgactgactaaatgacatgctgtgtaaatagactgtatcagtttaccctcctgaatttttattacagcatctatgtgctaggattatttgagacaataaccagctctggaagagtactttgagaaactcatggaattgtggaacatgcaacaaaagacatcttggagactatgtagtttcaccccctcattttagagatgagaaggcaaggagggtctgagcgggagagaggcttgtccaaggtcatatgacaaacactcatagagaggtggccagaggcagggctcctgactctcagtgctgaatcctagaaactttggccacttcaggagatgaaaggcaagggccagaatgtctcaacagtaatcccagcattaatcacaacacttccttgtcgagtgttcactagatcaatctaaggagagggatggatgttagtctcatttagaaacaacttgagacttcctggattcctcattttgacaccaaatgctccctgggatcaaatgtgatttgaaaaaaatggttggagtgtttgtatgtggttttctcctttaaaaaataaagctaagggaaaaagcctcccataatgtgttggcttttggcagcttttacaaatagtggtatgatgagaaacacatggccgaccagcgcttggtgaatggttatgagggttttgctgccccctagagaaccagaaggccaggctgtcctgctccagaggcctgacaacctcccagccactccatctcccagcctgagtcgctggggaagctggtgaggctggtggtttgttctgggcagaccagcaggtctctatggggctgaggcactggcttggtgacatttactgggaggtaattgtggcacctgcctcagtctgatgggtgcaaaggcatctaaggtataatcctgggatgctctggaatacttgatggcctcacccttggcgcccccaccttggtaggcttctggagatatgcattttaacagcatcaagcgttctgctacctgagagtagtggattgttaggtcactaacatggcaggaatgcacttcataaaacctcctatacacaactgcagtccagagaaggacctggaccagcgggagcagagctcaggacagggaaggtaggtggagaggagggagtggagggagggtccacatccagccctgcccagctctatttggatcatggaaacttagaatctgatgaaatgatgacgaagtcagatgatgactcgcctctggaagaatgttcaaggacgcatggggcatacaattccagtgatctctgtccaccttgtggtcccaccgtggttgcagattggagacccctgagttagagaagcagcccaggaaaggcacagttgcactgggggtggtgtggtagtggtgagggaacctggctaaagggcatgtgaagaatcagagagcaagaagggctctgggagatatcctgtcacagagaagggaactgagtcctagagcagagaagagactggttcaagaggtgaagggactggctcaagaggtcacagcacatcactagcagactaggattgtaccccagcccctcacccctccatccactgcctggcaacagaccaaatgggcccctctgctcctcactgcttccactttccacttcctaatgatcatgacggaagcccccactcctgagtgccagtgttacttctaagagggaaaatgttaactgcgtcatgaactttcctctatgggtctcccaggcaaagtctaaactctagttattgaaaacagcattttttttcatgtgggatttcaaatcagtgctagcaatgaggttgagtcccggggagggggatggagtctgggctccctcagggcaattccagtgaagtggctggctggtgtcctcttcagagatgtgtgtgtgtatgtggggctgtcctattgatttaattaatgcacttatttagagtctatactcagctgcttccaatgggcttgaggtggctttttcactctcagtgtgcaaataagctgactgaatatggatgacaaagaatatttttaaggaagaatatatgattgtttaaggcttatttggagcatgactggcagttttaattttttaacagcaattcactagatgtgcaaccttgggtaagtgacttactctctccctgtcctgactgtgaaatgaggataatgatagtacctaggatgctagaaggatgaaatgaatcatattagctaagtgttgtgaatggtgcctgacacaaaatgaaggctataaaagtgttgatgaataaataaaactttaaaataaatgcaggatggtggtttttagtagtcaaatctcactaactttacttactcagtatgtcctgaacccttcctactcctctcccccgattttcctgccctgtcttggcttagcccttcattcgtcctgcctggacagtcaccaatggctccccagaattaattcctctatctccagcttcatggtcctctaggataccgacttccctcaacctctaaagtaggtcttaaaacggactccccacctcctgtgcttaatccctttcagaatatcccacaggactcactacaggataataccctacaggataaagttcatgcctcactctatatgtaatattatttttctagttttttcaaaaattgtgattgttttaatccttgataatagtattctttaatgaacaagtctagcttgggtaaattttagaagccatctgtcttctttttactgctcttttccatcagtagcaatgtgtcacccaacaagaacttatagctctacggtctatactctccctgaacctgtttgcagaagaggagctgctgcttttagttgatttttttcatctgtttaattgtggactcagaccagatttggtcaggtttaagaccctggatgttgttttaagtcactgggttaccctttcctgacttattttcattctgtcaggctttcggctctggttctgaaatgaaggaaactttgtcctcacttcaacgtcttccaagcaaagtgagctggagagaaggaacatactggggcgagggaggcctggtatcctagggctcctaaaatcactctgtgtaggtaggagtgactggctcttgttcataggccatatctactcttgagtggattttgtggagtggttttgagattggcagccctttgggggtcctaggctctctctttgaagaaagggtcctgttctctggactggtgaggttcctttggaaatgcatctgcccgaagttaacaccaggactttatagatccagcatgaacccttcccattcaacagccccagaaagaaacagatccttacttttcaggggtcaaggtctcctccaggaactcctcgatcttattgacgtctgtcttcacgtccccgttgaaggtcaggaagggcgggtgcgtgccgggggctaggttgtgcaggtcagctggctttctgtagagagagcaagattcaggtgttggcttacagcagggtgcttcctgttctgggaaacctaagattgattgtaacttagatgccctgtgctatccaacatgcctgtcaggtgaaacagatttatggtatgcagtatagggcaggggaggttggagaaagttctgaaagaatgtggtgtgacccaggaagtgtgtccagtggagtcagtgagagaggaacaagtcaagatgaaggagttgaaaaaatgaaagaattgaaaaaatggagagaatccaggtgactatctaagtcagatccaagctttaattacccaggggagaggtggggttttgcttttaaaagctctttcaccaatctgcctaacaaaaatgcgctacacataattccatactttaaaaattaatgaattagatcatacttttctcctaataaatatctccagatacaaaaaattgggagtttgggccatttgttcaagttagatgcttctattgtgtgtaacttatattttaatatctaataactaatgtctaacattggtcagccttttgtcacactcaacagaatactctttttgagttataaacagcccctgatatggtctttgggtagccaggaaaataaacaaactattagattgaaaacaaaactattaaatgaagatgttttcaaaagtcttcttattgctaagattattgctccacaaacaccaggtaggctattaccaaggattctgaaccaagaacctcctactggtgagtaagaagatacctgagagaaagccttacgattcaagctccatgagggaaaggacccagaaccatgcctggcatataggaggccctcagtagatacatatttttaatggctacatgaataaagcatgcatttttgattcagctacagtggctcatgcctgtaatcccaccactttgggagggtgaggtgggaggatcacttgagcccaggagttcgagaccagcctgggcaacatagcaagacccccatctttacaaaaaaaaaaaacaaacaaaaatttgctgggcatggaggcatgtgcttgcagtcccagctacttggaagactgaagcaggaagattgcttgagcccaggagttcgaggcagttgtgagccgttgatggcaccactgccctccagtctgggggacagagtgagactcggtctcaaaacaacaacagcaataaaaactcatacattttaaatttaaaaatgagtgattttagctgcaaaagtagaaatcaaatgttggtctcaaattggtaaaaacttcaatccagttatgaaggctttcggctttcagttaaatgtggggagaaccagtaggcaactccactgctacagtattcatgctccaccatagtctacctttcacagtattttaacttaattcaagcatctactgttctcaaaataagacttattttgagaacatttactagatttactagaaagaagttatttttctttaaattttaaaaattctgttcaacatacataaatcaaaaatctcctaggagtcagaaattgtgcctatttttaaaaattatggggttacttaaatgttatcttaagttaaaaacaatttattttctaagtaaatgcaacttctgctttgtgatgggattcaaatagatcacttgatttatgaaagttatttcttcttatagcaaactttgctgggcccagtaggatcttttaggtaacacatacatatatatgtaataggcagcaaatttgctccctaagaagacagaaagctctttggtgtgcctgttagtttctgggtcagacacttaaagaaatccaagataaccaaagcaacagtgcatttctcccccctgggaaagaggagacccaagagtcctaaattatcctgaaagaaaggcctagatgatggagaagtgggtgaaattctggaacgcagtcccaattgaatgaatgaacaattaattaactgaacaattaattgaacttcctgcacttagcccacagcagtgctaagtggcatttctggcgtgcactggggagcacactgactacctgcaggaaggccaagtgcagtggaaaggaaagtggccttgtgtttgacacggctaggtcctgttaatatccaggagtgtgcttctgtgtctgcgccagctggtcagaatgcaagagcaagaatggagcaaaatgagggggaagaaggtttggcagattggggaaaatgggaaaggggagggttacactaaaaatgtttagggaagaggagggaaaatggtggcgacttccaagacggtgctgggattcaccccaaatgctctctctgagaatgccacatttcttgtgggagtcgggagtggaaaacattaaacgcagaaactgtaaaaaaagtaaacagtgggagtagaggagtctgtaatgaaacaaattcctggcgtaatcagtttgggaggggaagagaagaatttcaattactgtgctactcccatgtccctccccaaacacacacactctccagctgcattctgaggcacttggaactcagacaactgagacggaaagtatttttaaaatctaatttacttagtccctttatttactttgtgcatgtccctcattttagacaatgaaaggacattctttatttgctcctgttttttagagctgacacaaggcagcaacgtgtgtgctctcagtcacctctctgtggcttacagatacaggaatgtgtggtggtggtgatggtggtggtggtgggttttttcctgggattctggagaattgtggccactggagtcagacgcccttgggaagtactgcctatggccaccgacgcttagctagagttgcagccctctgtctttgttgaccctgcttcagtatttatagttgagactatatcattagcattggatgacgtattgccaggtatgatttatgaattatgtaatgaggatcggtcttcttttccttactggattgccagctccatgaacccagtgataattctaagaataaccaacatgcaacgagttcttgctatgagtcaggtacaggaccaattgcaaatgttttacatggcctgcctcgataaattctcacaataatcctattgattaagaagacactgtctccattgtacagatgaggaaactgaggctctgaaaagttcaagattattcagtcactaaagtgtagtgccaggaaaataaatcagttttcttagaaattaatgtgtgtgttcatgggtagagggggcagtaagaaagtttccttatctgtaaaaatggagtggtgctacatgcctggtctacgtcaaaggggtgttggctggaccaggtgtgatcatgtgaaggaggaaccaaaccatctgaagcacgcgggcaggggtggttccctctcccactctcttctccagcaaacatacaagtcctctctcacacatggtaatccaaacacctccaattctgcactgaaggaagctgctttttcataagtctgctgctctctttagttatcacagacattaattgcatagtggatgcaagttcatttatttgacagatagtatttgaggacctgtgaaaaactagtttctatggaggatacaaacaaacttaaaacacgattccagtctgtccttgagggattgaaggtctcatttgaaagatgaaacaaacttcataactgaggtattatgaagagcatagtatttgaaccaagcagatggcgtttagcccctctaatttctagttggcatcttgggcgagtctcatatatatctgtctcagttatttctcaaataacacggagaagtaagacctccttcacaggattatacattatgtgatttttttttaatgagaaagcatttaccagttgtaaagcattaggggtgcagacctcagaacttgatgaaacactaaatcacgacacaaggcaacatagacaacaggtgctgggtgagtctggagggaggttgggttgacaggtgtgcttgtatgagtgtggtgggatgggtatgagtaggccttacagaggggatgggctgaagctgagcctggggccagggacaagaaggaagagagggcctgttttagacagaggatgcagttctgccaagggatggaggctcaaaggaagaagaacagcagaaggcaggccagcctgacagagtagacaggtcacggtgagaagtgttgggaaagagtgttgggaagaatgaaggaaaagacaaatcggggcttcggatgcatcaagtccatggacaatgggaaacatcaaaggtttcctgtgcatgaaagtggcctgattaaagcattattttaggaataataaccttagaatcacataaaggatgggtcagagagagagaaaaagagaatgtgtgaacctggaaagatgaagaccagtttgaagaacaatgagactctcagggtggcagtggtgagacttgaaccagttgtaggctttgagaatgaaaaagagagtttggaggaagagagagtgcaataggagaatgctctagacttggctactgatcaacaatgaaggcagcaatagaaaggagcaggaagtgtttagtgcctagaaaatagaagaaaaagaccaggagcagtggctcacgtctgtaatcccagcactttgggaggtcgaggtgggtggatcacaaggtcaggagttcaagaccagcctggccaagatggtgaaaccccgtctctactaaaaatacaaaaattagcctgtcatggtggcatgtttctgtaatcccagctactcgggaggctgaggcagagaattgcttaaacccaggaggcagaggttgcagtgagctaagatcgtaccactgcactccagcctgagcaacagagtgagactctgtctcaaaaaaaaaaaaaaaaaaagaaagaaaagaaaatagaagaaaaaaggagttcaagaagagctcaactcagaggaaaaggatacaaattgatgtatgcaatgttagacatacatgataagagaacatccaagtgaaactatctagatgatagcagggctctgggtgtagaacaattcacataaagataacaaggagaatatgccaagctcaccagggatgaaggtagaggcagaagatgaacacttatggggtgagcctcgagctgttccacatttaaacaacaggtagaagacaggaaacagaatacattctgtaggagtgaaaagagtgtggctcctggtgtttgtaagtcattaaactgcactctaaaaacagaacagtagttgcttttcgtccaagcctgtaatctagaactgtcacactgaggacttctaaagctgggaacatagcatgggaaagggtctagatcacaactctctgaagactcagactctcacacctgaagtcctgctagggtcccacggatgatggccttagtactactgaaatgactaatcctatgtttttagatgtctgtgcccatatgtgcaccagaaacttagttgcaatgccattgtccattccttgcttcttctttgctaatcgtaacttgctaatcgggtcagtgaagtgctgggcaccaagtgaaatacttgcctttgcagactctcttgtagctaagactggatcctgagacacagttctggacaatgacgtgtgagcagggggctgctgggagccacggaaggcttttgccctccttcatggaaggttctctgttcatgcagctaaacatactcctcatttatgcaacgtacgttaccttttcagatccacagtggtgacattgaacacgactcctttcagccagaggatcatgaagaggcgctgagagaaaggacagttgccgatgctttctccatcgattccagcctggaaagaagagaaccagtgtcctgagtgggcaggtgcaattagcaaggggaacataagattgtaacacccaaatgcaggtctgaggagaccttactaaaaccatgtcccagcaacttcaaagggcggtagcctgatattattagtttttgccttaatgtccacgcagggcaatgcctggcagcatgtaagggctcaataaatacttgctgaattgaacttgatgattatgcagaatcataactttatgaaatcatagaacccttggggtaaaaatagacctgcaacatcacttagtctgacacaaatgatattggaatgccaacatctacacccccaagtaatcatctagtttctgcttgaatatctccactgaccagtcagttgtattaatatctctcaaagcagttcattctgaggattgctctaacaattagaaatgctttccttcggctacctagccaaaatatgttcctctgtagtttaccctcccccacccctcagtccttggatgtcatgaatataaatatctcagactttgatcccatctccctatatggaggctaatcaggaagctcaaggctttaatcaatacaccacttagttctggctagtacttggccttcactgtcaataatccattcatttgttacacttttactcaacaaatacatattgactatcagttatgtgcaagacactggagaaaattagccaggggattgaaaattgaattcctccaaggagcttatggccttctgtaggtgggcttggggataagacaggaacatatgtaaaaataacagaattattattgggtgttctgtgcttctgtcatttcatttcccttcctcaaaacagtaggcttttttaggtctgaaaagcaagtccatctttactgcacttctgagtgggctgcagatccctgaatttcataaagaattaatttcaagcaaacctatgaacaaacaaaaaaggttggggaattggtctctgtagaattcatttccatagggtggtttattggcccccaacataatacttagaggaagaaataacccatttgctccagactctgatgttggctgccctggaaaccatggcccccgcaggtggcctggcagggcattccactgacaggaagggcctgtgtgggccagggtactgaagactcgtacaaagctgtaaacaatccgaccaatatccaggaatgggggcttactgagttttttttttttttttttcaaaagaaagggagaaaacaaatgcgttctcgaagctcaacacactgttttctcccttgaggtttgttttgctatggcattcagatggggaggcagcgatgccttctttcatacattagaacctcattgtgtgcttttttctaccttgcaaattgctcccagcaggggctcaggtttataatggaaaactggaacttttgacagtgttggctgcatgtaattgctatgaaattacagttattttacctccctcttaactacaccaaaagccccactccctattcagttctcacttttcctcagtgctggaagcagacccacccctgagtcttgagaaagcacggactccgttatataaaatgggaaaggtaggagggtacagtgtgggcgctacaccttcccacggaggtaaagttaccaataaagcatgctcagacaggtggctatcaatttaataatagcttggtgctaacttgagtttatgatgtacgttccctaggaacttctcaagaagcacttgacaggtaccaggttctcggtcctttaagacatcccgacacaggaagaatttccccagggccagttatggtggaagtaacaagaggagaactgaagaaaaaagcaaaaacaaaaacagaagccagatccatatactgttatctgttttcctctggtggtggtggtgggaggataagggaattgaaggaggaactagcaaaatagtggacttctcaactacataaaaaattcatataataataatgttaataataacatatctatattgtcaggcattgttctaaaggatttacatatgttattaacttgtttatttctcctgagaagcctgtgaagtgggatattttcagcttttacaaatgtggaaatggaggcacagagagataaaataactggcctaaggttatcatcgtggtgaaaccaggacgaacgcaggtggtctggctagagatccagtgctctgagctgcatgcctggagccagcctgagggtccagccaggtaacaggtcctccccaggtgctggggagggctggtgttgaattgtatggacatcctctggtcagtgtgcaatcagctatgccaggagcatagggcatggtatccttcatggctccctacattttcattatgtcttattaatcttgtattaaactatgattctgggtttagtaaacaaaaattgtcaaagaccaatagaaatatgcgaggatgctaccatttactttcactgtctgggtgtccctctttcagcttcttctattccccttcaaatcccaacagccttgcggccctaagaaattgtttgttaaactcatgggttaaatatcgtgatctgtgacgaccatctgaaacatcaacagagaagaaccaggtggggctcagttgggccccacatcctgaaaagtgtgagggaaaacccaggtgtactttgttccagagagattttgagcactgggggccagggaccggcacaaaaacagtgtcctaggttgaatcatgttcccccaaattcatgtccccctggaatgtgtgcatgggaccttattgggaaacagggtccttgcaggtggaatcaacttgaagatgaggtcatattggattagaatgggctctaaacatgactgatgtccttacaagaagagggaaatttcggcacagacatgcagaggacaaagtcatgtgaagatgaaggcaatgattgaagtgatgtatctacaagccaacgaacgccaaggattggtggcagacaccaaaagctagaagagacaagtagagcctggctctgcccacaccttgattttgaacttctggcctccagaactgtgagagaatccgtttctgctgctatcagctatactatgtatagcaatttcttggaaactgatgcaatcagggaagtgtcaaaaagacaattatatatatatatatatatatatatatatatatatatatatatatatatatataaacagctaatggcaaacttcccaagctcatgattctgctttgaacatgattgccagctataatcctaaagtacttcctgttccctagatacagtgtatataacaacttattataaaatatcatgccacatataatattccatatggtgataccagtagtagtagcataatgtaattatataggctgtatgattgcacttcatctgttatatgctggatacttcatattatatgctattatatattgcctttcatgtgagctctctccatatatgatgagcttggctccctcaaaacatagttgaagttttatttactttgtcttcagcagcaacaagcacaggcacctgaaacttactttatattcagtgcctatttaaatggatgcatgctgaggggagggtgatgtccctccctttttgtggcttgaggatctcaaaattctctcactgacattctgaaaatcatcctaaaatacatgcatacatactacatacatacatacatactacatacatacatacatggttaccctgagttatgtagcacactagccggagactgtggttctagatccatctctgcctctacttcactatgtgaattaccttagataagttaccccctcttggcctcaaccactgcacctataacttcctgcaattttgtaaattcaagtggaaaatggagatttatttaagaccgcggttctcaaactttttagtcttagaactcttttatgcttttaaggattgttgaggatcccagaaaggttttgtttatgtggatgatagttattgatatttaccgtgttgtaagttaaagctgaaaaacatttaaatatttagaaaaatgctataataaatgtgtctattaacatacacaacatcttaacacaaaataactatattttctaaaaacaagaaatttagtaaaagtggcaatgttttatatttttacaaaatctttaacatctgacttagtagaagtcggcttccacatttaatctcttggtatttagttggggtatatggggcttttgttgttgttgttgttgttgtttttgaaacagagtcttgctctgtcatccaggctggagtgcagtggcgcgatctcagcttattgcaacttctgcctcccaggcagtaaatactgacaaatattaagtctgagtaagcatggtgtgtcagccagttgctctttcaggtaaaaactgctttgtgagggaggcagctggttcagctggcaactcaatcatacaagtgcttttccttccacaaccatcagactttggaatgcagccaaagagcttatgtgcatttcccatttcatcaaccagaatgtttagaagacatgtatgcaaaggttgagatttaatcacattatataatttttaatgcttcatcaaggacattcataattgaggctattttttttttctgcacatgcatgactggctagtcacacttataccactgcttggatttgtgctgaaacactagtaaacttacccacgaaataccaatcccagagagagaagcataccatattgatataactctaaaaatagttgtgacctcttaaaacccctgaaagcctcttagcgaccccagaagtccatgaacaacattggagaaccattgttttaagacattccatgaacacaccagatatgtaatacttggtttccagataatgaaggggaagctgataattggccaaaagtcactcgcgggtacccaagtccagaagtgggaggaatcattcagagaggatccaagaaggaattatagaaagtgaccagatgacattgaagcttgatagatgagtcagttatcaatttattgcctttcagctccaatgcacccttgaatatatgctctgtgagaacagggggaatttctttaaacatttctcctttaaagtgagcacaaagttaggctttctcaccagggagaactagaggggcactgcaggaggaagaggctttcttgctggctgtggtgtgggctgggggtgggcagtgtagctgtgagggcacgcagtggagccaccccagctataggctcagcatgcaacccccctggcacctcatagcctcagcctggcaataaccttcccagcactcttgacacagaaaccaaagtccccattaagcctatgtccagtcggcctatggccagtgtgtccacacagcttggtcaccccctttgcaagccccacgtgtcctgaaggccttcttctccactaacacctagatcctgctgcatgctgtaccgatgctgattgcctgctccctgcctgaactctggggagtgggctattgcttgctcagcgactccagaccagctctggcctgatcaaaccagtgagtttctgtgccaggttccaaaccacttctaagtttgtccttccctggctcctctccctcagccctagggtaccatagagagtttccttatatgtcatggttactcttttatcttagttaaaacttcatgttgaatttctcctgtttaagctaccatgtagtttctcactcctgattggacccagactacatcagatgcttaaatgtctgttatttcaaaatgtaagatttttgtgacctttgacttctttaaaaacctggcaaggttaagtcctggatgaagtattaggaaagaaacctcagttttctcaagaaagataattaagtcaccacttacgtcacatttccactttttgttgctgtcgcccatgaaacttgtccctgaggactcaagtgattaaataattttgttaagtgtacagataaaaattaagcaacagtagggctgtaactgacctcaggaatgctatactccagttctttctttttactggtagagaaatagacccagaaaggttaaatgaattgcccatggtagcacagctggttcccatagcagaatcaggtctctctaactcctgactctcagttctgagcagaccacactggctgctgtcctctagaaaagagtgacaaagtggcaaaggccacatgaaaaggactttctttaaacataatagctcatttaaactgtttagacaaagaagctttctttataataatatttccagctgcccattttttaattagttagtgtaagtcagacaacatttctagttgtgactattttttttttaataccaaacagtctatccttccaataatttggttggcaagacttcaattagcagggatgggacttggtggtacgtggtccacatgaggacagagaggtctacccttgaagaaatcaacatttcctttctcagaagccacaaaaggcctaattcactggggtcacccaggcatttttcattcaagaaacaggtaacaggtatacatttgaggctacagagatcctcaacatttatctaaagtttaatgtatgggcttaattagctctatgtagaccactacctgtgcaatgtgatatgaagaattctaggtatattggtcagagttctccagagacagaaccagcacaacatgtatgtgtgtgtgtgtgtgtatttatatatacatacacatatatgtacatacacacacacacacacacacacacacacacatcctgttatatctactatatatggagaaacgtatacacatcttatttttatataatacattataataacataatattatatatatgtgtgtgtatatatatatacacatatatataatacatatcagttggggtgtgaagagagagagatttattttaaggaactggctcacacagttgtggaggcttggtgtgttcagaatctgcagggtaggccagcaggctgaagccccggggaagagccgcagttcgagtccaaaggcagcctgctggcagaattcccatttcttcagaggagggggtcagtctttttttctatgaggcctacccacactataaagggcaatctgctttactcaaagttcaccaatttaaatgttaatgtcatccaaaaaaaaaaaaaaaaaagcaccttcacagaagcatccagagtaatgtctggtcaatatctgggcactatggcccagccaagttgatatataaagttaaccattacacctggcatatttaaatattttacttgattcaggtaacctattaattcagtagctgtcatctgcaccttagctcaccagatggttttgtaaacaattgaatatagttgtgtacatgtcccctcccaaaagaacttgtaggctccagacttagcgggctccttggtttacgcctctaagtgagcaggatccagtggtgcctttgatgcataactagcctggtctgatggtggctttgggcccaaggctgcctacaactttgtatgttgcacagtgccactgtgttcatggcccattggggtgtctgtcctttagcctgccttgagctttacgtccatctgccactgagtgtatgttcaccctcctgtgcttcacacactctctgagaaagaactgccctttccaactcatcaccactgtcccttctcccagccccttctttctactcctacatggcttcttttctattatttcatgtcccgctatttgaataaatgaatgggtttcttttaaacctcttgccagcctttcttctatttaacaacttctgaaattgttgtctttcaatctgtttccgggttaatcaattcttttttttttcctttgtgtcttcatcctacctgatattcgtcttatagctaaaacttttgattatcctttcttcttaaagctcagccatctgcagcctcccttgccacttggtgcctcttaggtgggaggagccagcttaacaggcaggcagtctgtgcagttgcatggggccccattaaacttggtttaatgctctgctgttgctatcctgaaattcttaataattttggagcatagggtccctcattttcatttggcagtaggcactgcacattatgcactggcctgcctgtggaccccttatttttcttgctgacatcctcctttttctggcatttgccctctcagctcaccactcttctcctccatgcttggtgctctttggagaacttaccttgagaacatgactgtccttcccaagtcagcaataactctggcttctaggcctataaacatgctacttaccctaagcttaaaaaaaaaaagtagaaaggaaagtcagagaaggaaagaaaacaagggaaaatgttgaaaggcttgcttggctcaagtctcccttgttggttccacctcctagcctatctcactgcaatgtcatatgttattctagaatttgcctcatttcaattaaatatcttgccagttactagatacttgaggttttcttataagtcagacaatatgccttgttattactatttttcaaaactaaatgatctgaccttccaataatctagttgctatgctccattagcatgaatgtgactcagtgatttgttttatttatctactctcagaaacctgtaagtactcaagaaatgtaagactgatggccttggtatgtcttccaagtgattccaccaatcttgggaaggaagaatggttctcatatgttaatattatcaaccttcaccatgccttgggagagcccaaagtccacactctctgcctccaagtttggctgtttctgctcactagcccaggtgtaatatttaacagctaaattccattgcagtagaggcagatttcagtcctcagcttcacagaatactgtggtacagtattaagggcattgtatagactcatgcaaacctgggttcaaattcctcccctgacaccaaccagcagaaaaaatgtctgcagcactatttccaatcccgtatgtccttcataacctttccacagccccagctagaggtggagtccacatttcccttcttcttaaaatagggcaggcttttgtgactgcctggatgaatggaatatggcagaagtgacacaatgtgtgacttctgagattaggtaatagggggtgatacagcttctgcctgtgtctctctctctgtctcttttgggatgcttgcccctggaacctagccaccatgttgtgaggaagcccagagcacatgaagaggttctctgtagtgttccagctaatagtctcagcaacgttttcagatgacagattgcctcaacaaccagacaagagaatgaatgagatttcagattattccagcccccagcttttgaattgtcccaaatgacatctagtgaagtaaaattagccattctaaccaagtcctggccaaatgcaggtttttgagcaaaataaatgttgttattgtttaaaaccactaagttttgggctggtttgttactcagcaggcaactcacatacacacttagcttcaggccccttatcttcaaattggtggcagagttgtataattggatgacaatatgtataaaacatatagtatttactttatacatttacagctactgtctttatggccgcagaaggcaaacatttaggaagagcttgttaaacaccctatttatgaaatattatgccttgatgaagagtcaatagacctctctttgatggcacaaaagttcaacagtacctagcgttcagggttttgtgtatgaagcaataaattcaacaaagaaagaaaatacatgaagaactacagctattgttcattggccagaggagagtgttcctaaactaggtcagtcatgcatttactatgaagggagagagggaaaagtgactcatgtttggttaactattggtacaatgatagatacatgcatgtctgttctctataagactattgaatttctgtgaaaagcaacaccctccaaccaaacacctttttcaagtagttcaagagtcaaagatgagaagggctggaacccaaggaatatagatggttgaagctaagggatcaggtccgggacagattcctggaagttttctattgaagtttattggaagcctttgtgttctctcaacatccggaaacattttcacagctctttaaggtactgtcatcctattctttagacctgattaaggctctcaatgcttggttcaggaaagttgaaatctggaattcttccacctcagaaatgtaccaaaacacaggaaaccaaagagcaatacaaatctatagcctcaaataaacagaactcctttccacattggtataatttgaagaagaggtctcctcacttaagcctcccttggagaatccccatcctaatacaggaaatatgttttccacttaatgaggccactgtcaaaagctttgctttcctctcttgacatttttcttatttgttatccaagatgctatggaaattaatggcagctcttgatcgtgaatccattccccctatatttaaggaataagcctgcaattcctataatcctcataccaaacaaggatatcttgatattgagctctgctactcctacaaaggttggtgtttgggatcctgacatagctgagattcctcaattattactcatctgcccttctgttctggttgtctgaatgttgagttttgaatatagcctcttaataggataagctgggctggaaagactttagagacatcccaaaatctgtcatcctagctctctgttggcttcaataatcactcatgaatcccaaactcaaatataacaaattgaaagcttatgacactaaaatgaaatctgagtcctgaggtttattaattagggtcatgtacatctgagaacttatgaaaaaagtttttgcaaaattactagtttatgatatgtcaacaaagtatgtttttagagctcgaaaattccacacaactaagcattttaaaaactggaatgcccaagccccactctcagatattctgatttaattagtctgggggtagggctcagacatcagaattcttttccctcaatgttctcgaggtgattctaatgttcagtcaggactgacaacttctgacctagtggtgcccacagtgggagatgtccaacagaatcaccaaaggagcttgttaaacaaacaaagaaacaaatgagctccctgacctcactgtagacttgcagcatcagagtctctgggctcaggagatgtgtgacgggctggaccaaccaccgacagtagcacttaggacgttgtttctccctcctctttttgtttcctttttccttacctaaactggaaactccttcacatcctggccccactcctacttcccaccccatttctacactgttcttcttcaccttccatccctgcacaggccctgaaagaagtgcaccattttgagttgttcagggcatggagagcccattttggatcaagatgtctgaagaacctcaagtcaatgcagccataaacaatgccaagaacttcacgtgccaactgatatttttatggttgcatctccacacagaactcttaagttctgccaggtgggtcttccctgagggtgacagagtgtgctgtgaccgggtacagaaaccctagtcactgggctcaagttctcatgtggtcaaccacaggccatatgtacccaaccacatttgttctctccagccaccttcctctagtcagccatggtgaaaaatgtggcttcttaaaaaatgcagggtcctcataaggtcctgttttgggctttcttggctgcgtggagtaccagcaagctgtatctccactctcaactatatgcaggcacttggccacttgggcagggtggatccacacagccagatgggcatctttaccaagggccagcttggttccagagactggggatgtagtgatgtggtgatgaaagagacatggtccctctcttgagaagctatcacacaacagaggcagcaaaaggtaaagacatgatggccaggtcatcactgaagtgcagtagtagtagagaatgggtggagtggggacaggaaggagcccacctaagggttcacggaaggatttggggcagcaacaatgcctaatgtgagcctcaaaggtaagagagtttattcatacaaagtggcaggtaaggccatccaggcagaagtgatggcataagcacatgcctggaggctggattgaacaatgcaggtgtattaggctgtttttgtgttctgtaaagaaatacctgagactgggtaatttatattgaaaagagatttagttggctgatggtcctgcaggctgtacaagtgccatgccagcatttgcttagcttctggttagggcctcaggaagcttatgatcatagtggaaagcaaaatgggagcaggcactttccatggcaaaagcaggggcaagagagagagagagagaggaaccaggatcctttaaaccacagctctcctgtgaactatcagagcgagaactcactcattaccatggggagggcacaaagtcaggagggaaccaaccccatgatccaaacacctcccaccaggccctgcctccaatattgggaatcacatttcaacatgagatttggcggggacacacattcaaaccatatcagtgggtgtgcagggaattccaagcagatcttcttcatgctctattaggaaaacccatgcagaatttctctagttccctttcttcctccattctgaggaccccagcctagtcacaggcaaagccataaggcagtcaaatgctcatcttctgggggtctctgtgtcttcccaatctgctatctccaccatcatgcatctctaaacccctcagccactcttggccagcatgcctctccccacttgtatctctcaatgccaactctgaaagcattcacatttaagtatgaattgttggtaactgctaagcacttattcctcctggggtacttttatttatcatggcccagatgtaagcaacgagatgaagcttcaatagtggggttgcaggtgtctgccagaaactgattaaagaactgggaaagaaggaagaagggcaacaatagcttcctgggggtcctgaaaccagacatgtaggtttttatctattatctcctatgtgagatcctgccaacttgttacttctgcagctctgaaaaactagctcacacaatggatgccccagaccaaagggcaggcactcttatcacaaaactgccttaatttccatttaaaattttctatttaaaattacttcaaggctggttggaagggcaagacttcaaaaacaacacattcctttttaattaattggaggcgggtgactataggaatgttttagctttgccgttaatatgagtgctatgaatttgtaatagtgacatcttcctatacttgtgcagtaagatgtttgttagcaagaatgtttggagaagcaagatgttccctggtgaactgaattccctgggtagccctttaagcaatttggggcaatgtaataaaaagcagaagattaagagttctgcgttccagacctagttttggcacaaagagttgtgtgacctagggcaagtaattttccctctctgggtcttaatcttgttatttttaaagtgaataaattagaaaagatgggcttgaaagacactctgttcctaaaatgtggctaggagaaggtgaaaataactaaatcttttatttgcacctaaaaattccaatggctgagtagagactccacaagctactacagtcctctctcccagcaccatgcatggctcacagcacgggctggataaatgtttgccgagaggatgaaagagcttgtggactagcattctattctgaaaacacaggcagctggatctgcaggggaggggccagcactgtagattgcaaggaaaatcaggccacaaaggaagaaccacctgtgaccacctttgctagctgcttctgggctctgccttctcacaacttctctgtagcatctttccatagtattctcagcaccttaccttaaaaagcagttgaagaagcaccctttttggaaggctgtccccaccccatgtccccgcccccaccccctcctgctctatccaactccttcagactagggcagttgagatccaaagacttcagatgacttttccaaggccacatagacgatcggtagggatggagtttgctattgaatggagatggctgaaatctcagtcaaaatcgtgaacgtatgtaatttagacataatcagggaagacaggaaaaacagaactgaatcctttggaaagtcatcttcgagagatgttcctgctaacccttgcttatctttcattttattcccttaaaagagtaaactgctgaagacagaggaagaaaaatcctgccttgttattgaatggtatggattcacattcacatcaaggtttttttttttttttttttttttaatcgtggaggatttactcagggtaaagacagaaagccacactcctacgacaggtcctgagctcccaggggaaggatagaagggaagctgtgtagctgtcttttctcactatgttccttcttctcccgcctagggtgattgggaggattaggggagataacacaagtaaaatgggggcgcagtgcctggcagaaagcactcagtgcatctgccatcttcaaggtcactctgccctctgggcccattcctccttcctccctctcctcacccccagccagcacattaaaggtcacaggtctggagaaagtccttctctgccactgtgcaacagggaaatgtttctcccagccaagtgcccctgtcatgtgggcccacccaactaatttcttctgagcccctatagaacttacagtgaagactgtggttagtcctggatgattatatcttctgctttagaagggagctttgaaaacagcctcacaattacagaaaaaaccaagccagtttttgtgtcaagaagacccaatttcgttttctcagccttgaaaaaaaatcaatttgaacttgctgctggctgagttatatgttcaagctcagaccgagctgtaattggaaaggagtctgtcttttgtaatccccaggccaaaaggggaaatgaaaatctttttcaaatggcagagtaaggcaggaaatgttctctttattgtactcccataaaaaaataaacctacccagtaattataccacacacacacaatagtccaggccctcacccaggaagccacaacctgagatgaaggagtcagtggttattttcaaaaagggaatttttccaagccctaccatattttctctcacaagttcctttgcatttacaagagacagattgcccaccctgcttttctgcctgactggtggaagtcagacaacctgcatactggtcccagttgttctgcaagatgaatgtgcccttgagcaagtcactgtctcgatctggcattctgcacccttacctatgaaatgaagggacaactagacaatgcctacatctgaattctctgattctctttatgctcacttgttcattgggcacaaaggagtcagaggtgatccctgcttatgaaaagctctaatgtaaattctccactttatgtctaggagaaaaaactgaaagtggccattataaaaatacaaaactgccccattggtggactccaaaataaatgaggtacagaaattgttctttttcctctactggatcctttctgtaagtcttagaatttgctatgatgctcttggggcattcaaattcacaagcacaaaaagaactacattttgggtaccacattctaatactactatccacagagtggattcctcaaatcagccatctggtatatagaatatgtgaaaatgcatttccagttctagcagagattgttccatccataggtctagagtagaagtatatgtaatcgttgacaatcaacaaagcatatcacttatatcttatttagtttgaaggtgccgaacagggttgttgtacatgtttttaaaaaaattttattatggtcatctcgtctccacccaaacccccaccaaactatttctaccctcttaagccagggtgagccaaagtcccaacctttcctttacgtacaagacccacctaaggaaggaagcctgctattgttggactatgtttagaacagatgatgctacgtgatgaacttcgagcattaatgacagatagtcttctagatcctatctaatgtttaggatcagccccttcaaattgttttttgatggagcctcaggaatggcaaagaaacattgcaacttgtgcttcatctgccaattattgaaggaggctgctggaaacataatatagaaaattctgaggtctcaactaggattcgtaggacagaatgtaagcattatttggtgatgacatgttttatttataaagtcaaccttagatgcaattctgctgactcttctacacagagaagaggcctgctgaagaattaaaagataagaacaaagctaaaatgagaagcataattttcccctatgtcctcctagttagctcttatggacctttctgtaacatgagtttcttctactaagttgtaaaacagatcctgttttacttttctcttctcagtcctatgatacagttcagggccagacacatttactctagttgttcaaaatgtagcctgcatgaaaagaccagtgtctcagagacataccaaagggcagaacagaaacaaggcttagaaacaaatttaacataagtagagtatgggtatcaaggacttttactgtatagcgcttgcaattatgtgattagctttcagcaagatgtgttttctctctatcttttcaaccagaaaataatttaaaaaacaaagataacttgaattggcctcaaagctgtctccatccctgtaattgggaataataacagctgcccacctacttcacgagttctctgtgaggatcaaaggtgctctgaaaggatgacatacaataatggaacctaccactgccatatcctgtcttctttgttagtggattgaaattccagctagaacacaatgtcctacagctccagggtcctcttgtaagtttatctctcaatcaagtctcattaagagctttttatctctcccctggaactcccagaaaaggccctaagagggatagttttcttgttaggaggaaattctgggttgtctgcagccttgctgctcaaagtaggtccacagaccagcaacatcagcatcctttaggagctcattagaaatgaagattctcaggccagccccatacttactgaatcagaacctgcattttcagtaagacctctaagtgatttatgcctcttagtgtttgagaaggctggtcttcagaacctttgcaagataaaggcctcatacagcaacaatcggaagacctttaaaaccgatgcattgggtcagtgatagccagcttttctttttcatttaaaaagtgcatctttgcacatccagatttcacataattcttggttaggaaaaacaaaaagaaaaacaaaaacaaaactccactcttgttcatagtaatctggccctactgggttctaaaaatgtcagtgaatctctgccaaatttccatacctcgtgcagaggaggagcctgcttgcaaataacaatggcagccaggtgctgaaagtggacactgaagctgaaactggagctgaggttaaattatttattgaaattccatgacttggcttgtctgttagaagccaaccaaacctagagtcactgagcatgttcatctcgaacaggccccatcctgcaccccctgaagttacctgcctctttgcctgtgggaccagtcagatgtcggaccctacctccaggggttaagttatggaaacatgacatggctgggttagtaaactgggctctctaaaggtgctgtcctgagagctcctgatgcccatggctgagcagttcagtggcttagcagtctgcctctgtgcaacctctagttcatagaaagcctgcctgttgcaggaaaaataactcgcttgcagctaactctttcttttcattttttaaaatgaacaccctttgtctcagggtttctatttgtatgacagagagaaatgtgtttttttgtgggtgtttttgtttgtttgtttgtttttgccaaccaacatcccaatatatataaaatgaattaaaccctgtagatatatattccttttacaatataatcactaatatttgatcctcaaaagcaaaatactatgaaaacatgttcatcaatagcagaataggtggccgggcacagtggcccatgcctgtaatcccagcactttgggaggccgaggcgggcggatcatgagatcaagagattgagaccatcctggacaacatggttaaaccccatctctactaaaaaattagctgggggtggtggcacatgcctgtagtctcagctacttgggaggctgaggcaggagaatcacttgaacccaggaggcagaggttgcagtgagccgagatggcgccactgcactccagcctggcaacagagcaagactccatctcaaaaaaaaaaaaagcagaatagttgattacaatgtgatataaccatatgatagaatagtatacagctatttaaaagcatgagtttgattcttatgtattattctagagggagtgtcacagtaggagaaaaaggcaaatgacaaagtaataagaacagtgtgatccctttttgtatttaaaaacaaaatcttgcatgtgttcgtattgtacgtgtgagagagaggagaaatatatatagttttatatataaaaccaccaggctgggaatcagaaatcctgggtttctgtccttatgctcccctgagaagtgggggctgctcatctctgggcctctgacaccttctctgcctatcagtcagagtgacagcaagagtcaaatgagaccatgtgcatataagggctctgaccagtggaagtgattatagcttccaggcacctatggaaagatgaaggttaatataacaattatatttatatatagggcagaatgaaataaatggtaaataggagactcaacaatatgtttttcatgtcttgggaagcagtgtttactactgtgtgtgtgtgtgtatatatatatatatatatatatatagagagagagagagagagagagagagagagagagagagagagaaagagagagagagagggcatgccatagagaggagttgagggcaggacctgatactgataacatcagtttcttcaggtgggtgcattcaaggggtgtgtgaaaggagagtcttcatattttctttatgtggtttcaagcaaagaaatatttgaaacccttgggaacagatgtgtttcaaaattcaaaatattttggaatgtagaaaggtaacatgtgtggatatatatgtaaccccatccccaccccctgcaggctctgggacaccacactgctgtaatcaagtctgttataatcacatctccacagcaccaagtggggcaaagatggactacaaatcatctctaaagttcaaggaagttttgcctcaaagtgaatttccacaaacttatgaaagaacttacagttttcagagctttttgaatttcaggattacagataaagaattgtagacctatatatttctttaaggtttgagttgtcacagtcatcttgtatttttaaaacaaataaagtaagctaaaagggaggtgacaaaaaaagaaagaatatatgaagaggaaaacccctctgatctgcccttgggtccctttacttgtgcctccaaaggctctgatttagaactggagagtgagcaggatgtagctttggtgaggcacactcaggggtcggcctgacctggggactggaaaccccagcaaattcaagcccactagcctgccatgtagcagatacaggagaatggcaaataaagatgaaagaaagacttttaatgaaatagaaagtaacttaggtgccaaggagtaaccagatcctaaagtgatgcccacgtggctcctgtcattcgatatgcaactgaaacaaaagtatttctgtcaaagttaaaatgtatattttaactttggccaacagtgactgtccaacacatgtatagatggcatcctcagtccagtgtgccaggaaccagtggtgccctcagattctcattggggcaggcaagtgcttgtttctgtctaggtctctatcaatatggacatttattttaaatatatatgtatatagttatgttgctaatcttaaaaaaaatcttgaaatgtgctttaaatccaagtatatcagattacaaagaacaagacaatatgttacctgtcaatctctaaggtgcaactgctgtacaacttgagccaagttagctggagccttcatttctcttactatgaaataggggtacagtaccattcatcaccctcacttgaaaggtatacaatataattaaaaagtgcttaaaagtctttggcttaatttatgttgtaaattataaatagcctatttctctatgttatataggtaaaggaccagggcctgaatgtcataaagagaatgtaaatgatcagtgatggaaaaaaaaccaccagactgggaatcagaaatcctgggttcctgtgctgatgctcccctaagaagtgggggctgctcatctctgggcctctgacaccttctctgcctatcacaaagagtgacagcaagggtcaaatgagaccatgtgcatagaagggctctgatcagtggaagtgattatagcttccagtcacctatggagagatgaaggttaatataataattatattacgtatacggcagaatggaataaatggtaaataggagactcaacaatatgtttttcatgtcttgggaagcagcgtttactactgggtgggacatcggaaaagtgtcctttcatttttattattttcttggtagatttgttttttgtctgcttgtttctttctttgttaaatgtgtagtgtgagtagacatcccagcttgcctaggactgggggaattccaggactttcaggatttaaaactgggaaggtccctggaaaactgggatgagttggtcactctatgtacatgcatttctactttcagaaaagaatttgaaggcatggttagacatagaagcttacatttaataaaggttggtgcaaacgtaattgctgtttttgccattacttttaatggcaaactcattcatacaatgcccatgcacagacagactttattcaattcaaagcagttaaaaatgtcaaataaccccttcttagtacttttggttcatcgtactacagttttgtccttcactggatcaaacgtagtgattctcagtattaataatcactccagactctgtctaaatattcaaatgggtaatggacattataatggcatagacctatgaggtttcctaacattaactagaatagacaaaaggcagcttgtcggaaaataacactaacaacaacaaaagggatattgctgatgctttttagggctggatgttacgtgtgtgctgtatgtatgcaatgtgcatattgtcttcccatgtttggttgacttttcattgctaaatgagcaatgtagttcatacagatctgcccacatatcaaaagaataaattatttcctttcagggctttgtcttttgcaagaaagtggtgtttaaactatatagttgatttataataaatatttgtaataaatatttattttaaataaacagattgggtgattatttttatttcacccttgaataacaaggattatagtaactttttcattctttatttttgactttgtggccttttggattttgcatgctttttcctatgactccacttcaggtgtttatagtgaaacataaacctctttttatcaaattccagtgcaagctttaatgacaagcatattgtaattattcttgctacattcaaattgtaatgaatcaaaatggtatgtggctttttttgaaagatgatcttttagttgctatttcaacaaaccccccagatctggagcccagctaccttccctccatcttttgtaaattaaaaataaaaaaatggatatgatacaatatcctaaattatttctttggcccttttgagcccatactcagaaccctccaatgactttgcactaataataggataaaattcaaactccttgagctgcctctcagggaccctttctttttccagggttataaattctcccctttcaagacctcttcccctgcctcccctcccctctaggcaaacagcttgcccacctcctctgactaggctcaggttggctatgtctgcacttttgttcatgtcatttctctcttttggacagcattatctgtctctactttcaaatactaactcagaccccatcttccctggaaatcctcttcagactacttctattagaattatgttgtgtatagttcatttcattcattcacttgacaaatactaaacatcaacaatgtgtggggtgctgttctaggtgcaagggatgcccagtgggtttccactcagcgtctttccctgtagcttgctgcagtggtggggtttttctctggaagcaacagagcaagaagacaaaagacaatagcagggaagctcctgggctttgggtctgactaggctttgccacttactagggttgtaatcttgggaaagtttcctggcttcagtttgctcctcagtaaagtagaaatatggtgtggtacttaaaaagttgtggtgtgaatttattgtccatgtaaagcatttagggatagtttgtggtgcaaaataactgctcaataaacagcattacattatgatcttatacctggtctgacccatctatggtgccttttttcccctcagtgctttccatatccgagaacttagtgttgggcttccttgtcattgtgtgataaaatactcttctctttgactggggatggctaacaatgagtgattcctgagcaggaatcgtaagctttccaataaaaatatatgtggggattcttaaatattttaaatatttcagtgaaggtctatggggattctaggaagtattcaacaatatttattaagaacttctagaacagtggttctccaatgttagcatgcatcagaaccatttgaaagccttgttaaaacacagtaggtccagggtggggcccaagaatttgcatgtctaacacttttacaagtgatgctgaggcttctagtgtagggtccacacttggagaacatctgtactagaagttgggattgaaaataattatgaggctgggcgcagtggctcatgcctgtaatcccagtactttgggaggctgaggcgagtggatcacctgaagtcaggagtccagctgacccacatagtgaaatcccatctctactaaaaatacaaacattagccgggcatggtggcacatgcctttaatcccagctacttgggaggctgaggtaggagaatggcttgaacccaggatgcggaggttgcagtgagccaagattgcaccattgcactccagcctgggcaacaagagcaaaactccattaaaaaaaaaaaaaacagaaaataattatgagagagctgtggatcagccttccaaaggagctcaacagccagagtttgaaaaaaaatgcacaacagggtgggatacacaacagccacggaccaggttagacaacactaagtggagccctggttccattattcactgggatataaccttggacaagtcatttacctcctctgagctttgttttccttattcaaaaatgttagaataagaatcttccctttatatctcacagtgccatgaagacccaggacacatgtattatatgtgctaactgaagaccaatcttcaaagttcaggggaaggggcatttcctcccctttctccagtccaaagtaactccttgaatagacaagagaccctctaagcatgtcacgttctttcctcattcactaaggcattgttcaatatcttaaagactgaactagctgaatagattccctggtaactcaaaaccttaaagcagctttgaattaagagcctgtctctgggaagtgacatttagggaaggtccactaaggctatgtgggctccacccactcttccagccttctgccttgtcctgaatcacattgggctgacaagattagatattcctactgcataagattagcacctgtgaaaaatcattctccttgaatcacattttaatgccctggcctcagtttttacagttactagatgaaataatcacccaaaatttctactgcattttctatttaaaaaacgttgatggcattgttcattatatttttgagtgatccccacacactacttataaaccattacatgagaaatggccttttagacctttgtgagatgcatcatagtatgcaaatattttctcccgttctgtaggttgtctgtttactctctctgttgatagtttcttttgctatgcagaggttcttttagtttaaccaggttccatttatcaattttttatttctgttgcaattgcttttggagacttagtcactttttttttttttttttttgccaaggttgatgtctagaatggcatttcctaggttttcttctaggaattttatagttttaggtctaacagttaagtctttaatccatcttgagttaatttttgtatgtggtgaaaggtaggggttgagtttcaatcttctgcatatggccagcctgttatcccagcactgtttattgaacagggagtcctttctccattgcttgttattgtcaaccttgctgaagatctggccttaggcatggggctttatttctgggttctttatcctgtttcactggtctatgtgtctgtttttatgccagtaccatgctgtttcaggtagcaaataaaggcaggaacataaaaccaaatactgcatgttcttacttataagtgggaactaaacattgaatacacatggccataaagatgggaataatagacactagggactactagagggggtagagtgggagtggggtgagcattggaaaactacctattgtgtactatgctcactacctgggtgacggtgatcatttatataccaaacctcagcgacatggaatttacccatgtaacaaaccagcacatgtacccccaaaacaaaaataaaagttgaaaaaggagagagatggctttagaatctatcaccacaaagaaaagaatacttaatgttaagggaaaatgctagtgataaaatgttgtgaatagagcatgctgcaaaatgtatcggttgtataattccaataattaaaaaaaaaaaacctagaaagaaaccaaaacattatcagaagttatctaattacttttataaatagaaaaaaatatttttcaaagtaattcaatgacagggaatttcatcttctccaagaaattgtcttcttccactctcaaaaagagaattctataactcattgtgtcttttttccctccttgccttcttagaagctcaaagatcattatttgaagcatgcattgacccttattacaggttcatttagtgcttattttcattttctgttttgttttgttttgagacaagatctctctctgtagcccaggctgaagtgcagtggtgtgatctcggctcactgcagcctcaacctccagggctcaagcgatcttcccacctcagcctcctgagtagctgaaactacaatatttaccaccaggtctggctaatttttgtatttcttgtagagatgtggtttttccatgtttcccaggctggtcttgaaacctgagctcaagcaatccacccacctcagcctcccaaagtgttggaattacaggcatgagccaccgcacctggcctcattttctgtcttattgctatttcattttacacgtgcttactagatgagtagtatctacttatataatttctgaaattttgaaacatcctgaactttttacaaactaaataaggagccagaagtaagtgatatgtaagttccaagaaaattaaacaactagcttctaaatatacctcaaaaagtaatgtggtttctcaaggcttgtgctttgcagtgggcaaatctgatttatatatttatcaaagaccataatggatattacattccttttctgtaagcagttgatactcaatgagatacaatgtggactcccttagttaccacctctgtgggggccaggcctaggtgggaggaaaaccttgcactttcatattgctgttcagttttggtgggcatctaccaagggaaccactctggaggaagactctctgtctgatgaaatacaggggacaggccaggtgcggtggctcatgccaataatcccagcattttgggaggccaaggagggtggatcacctgaggatcaagatcagcatggccaacatgatgaaaccccatctctacaaaaatacaaaaaattatccgggcatgatggcaggtgcctgtaatcccagttactcgggaggctgaggcaggagaatctcttgaacctgggaggcagaggttgcagtgagctgagattgcagcattgtactccagcctgggtgatagagggagactccatctcaaaaaaaaaaaagaaaaaaagaaagaaatataggggacagtcaaggatgacactgaggttttgatcttggaatgttggaagatggcaaagacaatatgagaaacgggaaatgtgagggagctcagctttaggggaaggtttctgtgtaagaagaggtagctgtagaacctgtagtttggaaaggtgaacaaaccttggacacctaaccatgcaggggctgtgattcttgtcctgactccatcttatcagtttgggtcacctggggcctgtccttgctgctcctgcttgggactcagtgtcctcatgaatcaagcttgttcatctctaaggcatttccagtcctttcagtggatgagttcatgatattataaatttttttatacagtcacgaattgcttaataatagggatgcattctgagaaagggatctttaggtgattttgtcactgagcaaacatcatacagtgtacttacagaaacctagatagttccagcctactacacacctaggttatatagtgtagtctattgttcctaggctataaacctgtccagcatgttgctatattgaacaccgtaggcaactgtaacacaagggtaagtgtttgtgtatcaaaatatagaaaaagcataataaaaatacagtattataattttatgggaccaccgtcttctacggggtccgtcgttggctgaaacgttattatgtggtatgtgactctgcaactcatgagacattttacacatggagataaagacttgggtcaactctgtttgtctcagattgcatggctgcatagatgagtggttttaataagggacatttaagaagtcaatgattcgcttttagtactgactgacacttttatctcttttctgggaatcagtctaaatggcatgaatttggagtttgtaagagctgaaaagaataatgagaaatctagaaatggaataagccttggtaaaaggtgagaaacgattcaagcataaggtgaattactaaggctggttgcctacttttatgagctgcacagggaaaaggccacaaggtctgggaaatggaagaaaatgaaatgccaataaaacaaaggaggtgggcttccttgtaacgtacattcagtgagagatcataatgctcaacaaatctgttaaatcctcagacctctgcccagggactttttcactgcctgacctcacctgatctaaagttcatgcagcagcacagggagggagggtgagaggaatgctggggaggacttggatagtattcttactaggaagccataaaaatgcatatattctgggacagggtgtgtgctgtcatgcacagagccaccaaagtgtcatcaaatgagtagtgtccctatactacctagtgggagttgggtttgggtaagtgatgtcaatatacagccctcaggacaggaagaggaatgcttggcacaagacacaccattgagaagagttttgtaacaatcggttggaagagcgattgtggcattccttatagctccgctctggctaccctgctcctgcatatcacggccttaggagttacagacgcttgggatctctgagaagacacatagaagattcaggtatggactggctggcatgtaggcaacaggtaggacaaggtaggttgggggaatgcctgtgtaaagagagaatatagacaacccttcattcattcattcatttaaatgtatgcacacatccattcaatcaccaaatatttcctcacctggtaagggctaagaacctgccttcgggcctgaaatataatgcctttctcagataagtcttttatacccttctcccatttaaattagtcctccagttatttccttaatagcactttttatcacctgaaattacttgacttatttctttatatcttctctgtctcatccactagaacacaagactccttaagtcaggaaccatatctcttttgttcactgctgtagtcccagcactaaaatcaatgtccagcacatagtagggcctcagaaaaaccattttttgaaagaaaacatcatcacagagatgaatagaacctaggcccttcaagaaaagagtcaaagagagtgtgggaaagcacttagtggaacatagtaaaggaaagagaaaactagtacaaaaattgaattggttttcccctagagatttaaaaaagtacttgggattaaaagacaaataaaacattagaggagccatcagtgcattggttccttgtgctcaagatgagagggatgtgtagaattaattctcgagtactttccaggcctcctggcctgggagtctgctgtcttcaggtccgcaatgccagtactgtcacctgtgctatccctggactcaccatgttggggtggaagggacatttgacaggtgctccggaacccagcttgacattgacttctacccggctgtgtggctttgagacgagacagttgactttgggagcttcagcttttctctaccagtaaaatgagaatgacacttgtactaagtgccccgcctccacagttttgttttgaggttctaggtaatgtagtacgtgtgcttcataaactttgaaacaacatacagatgtttgcaaatgacaggtcaccaggatgctctcccctggtcactgcagggcaaggctttcatggtcttcttgccttcgctggggctagttacccacaaaatggagttctgatggtggactttaaaggaaaaacataagccattcagcgagcagctttgtttacagccatccattcaaaatcactaatgaagaattcattgaggtttccatgatgttttctttctttttaaagatgagatgactgggtctcaagaaatccttctttccctccaaagacattcatcgagcagctctatgcctggaactgtcttaataccagggaaacaaggtcggtaactgccatccttgacgtcatagctgcctcacggggaagacacagaacatttggcacactcatactcttataaggcaatgggatctgagcagtgaaaaagtgcatgggagatgtgggaacacccaagagagacactgaaattagcttggtcatgctggagggagggcctggaaaggccttctagaagctaagccctggcaaagggggtaaggaacatccacatagagagggaaacctgtgggagagaagaaagagcctggcccctctgggagccctgagctgttgttcagtgtggttgtcacttgggcagtgaggtagggagtggtaagagatgggcccagagagataacagggagcagatcatgaagcaattcattctaccttcagggtttaatctcatatactctaattttcaggcgagaatctaaaagttgctgtgccatttagtacagcagagcaggaagtatgtgtatttgacctccttgttaatttcttcccataggtacctttctgtaaaaagcaggctcatccccaaaacactgtgtttcaataagctcgatgcagtgcaacagtgaagtgactcctttcttagcagctgggttggaaatgcttctgtgtccctccagacctgctctctagcctcaccactctgcttggggcctggaggctgacagtgggaatagcatcaaggggctccctgccctctggctgcattaggatcagaagtcctaatgcacgcgaagttgggtatttattgccttggccccatccctaccaggccactctgggttggctgcatcccttttccaaaggtcatcctccttccagtgactctttttgggtaaagggtcagatctaagtaaagggtccttgtagttgttctcccatgtataggcctcaattatctcttgttggtgcctgatgtggtttggctgtgtacccacccaaatctcatcttgaattgtagctctcataattcccacctgtcatggcagggacccagtgggaggtaattgaatcatgggggtaggtctttcccgtgctagtaaataagtcttaggatatctgatagttttatagaggggagttcccctacacaagctctgtcttgcctgccacaatctaagacatgaccatgctcctcattcaccttccaccatgattgtgaggcctccccagccatgtggaactgtgagtcaattaaacctctttcctttataaattactcagtcttgggtatgtctttattagcagcatgagaacagactaacacagtgcctttaaccctgatcatgccctgagatcctgacacaccatcattgatttccccagcatcactggattctttggtgtaacaggaatgcagggtggtcagaatccttggtaccattgaataaagctacccagatggtgaggagcactaggttaggagtcaggaaacccagcttctactcccagcttggccaatgattagctgtgtgacctcaggcaggtaaaaatcctgccatgcattcattctgatgaaaggacattgtagcctaagaaggtagtgatgtctgcaaatggaaagggtagaattgtctgctccagctttttgtgagggtgccttaagggccactttggggtcaagaaggacacagccaggataagccagagaaggccttctttaaacttttttttctatagtgaggctccacacatgatttagttgacataacaaagaattccttgccaccaggaaacatttgaaaacaactgggctcaatgaagttatgaagtcctgtttggttttcagagctgagatttcctctgtgctcattcactgggtggagaccctggtaaggatacaatctcccctgcattccacaagtacagcagctagtagctaaaccacttgtggggtcacttaattgctttgattataaagaggcagtaaatgtgaccttgcccaacttaaaggagtcttgtgcagggacagaagaccctggggtcatattatttgtacacaattccaggatagcattaacctgagtcattttccatgaactactcacatgtatcagtggcagtgtgtctcacttgaaagtcagtgtgcctcttgtgttgcccatggaactggagacctgatactctttcactggcagccactggaagatgctgagaatagcaacatgagtggcactgtggacttaacccaagcatttgaccccattaacttagttggtatgtgggaagctctgcaaaatgtttgcttcctagagacacttattaacatcacttctcactctacaaaacctttcctgataattgtcctgccagaagttatggcccctccctctgaactcaacattcagcatgcttttctgctgccctttaaagttagattccagttggtgtgcacacctaagctctatctcttctgctaaactgtggtctccattggagaaagaaacatgttgtacacatgtctatattctctacagtgccttatagacagatgaaatccagaaagtgtttattgttttgttagctgacagtcagggttgacctgtgagggaactataagatagatttttgtatcgttgttataatcacaacaccaaagtcttagcctgttcagcctgccataacaaaatcctgtagattgtgtggcttaaataacaacaaaagaattatttttcacagttctggaagctgggaaatccaagatcaagatgccggctaatttgattgctgtgggggccttcttcctggtgtgcagatggctgccttccggctctgtcctcacttggtagacagagggagaaggagagggagagagagagagaatatctctcttcctcttgttataaatcccccaatcctattggattagggctacactcttatgacttcatttaaccttaattatttcctaaaagcactatctccagatacagtcacattgaggattaggatttcaacatatgaattggtgagcacaatttagtcaactgcattctgtccctggccccccaaagttcatggccttctcacatgcaatatgcatttattccaccccaacagccctaaaagtcttaactcattccagtgtcaattctaaagtctaaagtccaaagtcccatctaaatatcatctatatcaggtaagggtgaggcctgaggtgtgactcaacctgaggcaaaattccttcgcagctgtgaacctgtgaaatcagacacattacatgcttccaaaatgtaatgttgggataggcataggataaacattacaaaaaggagaaattggaaagaagagaggggtgatgggtcccaagcaagtccaaaacctagcaaggcaaattttattagatcttaaggtctgagaatagtcctttttagtttgatatcccaccttcttagcctgctggggtggcagttctgcccccatgactctgccaagtcaggttttcaattgattaagtctcagccacgttagggagggcaatctattttttctcagtccactaattcaaatgttaagctcacagatacactcaggataatgtttgatcaactatctgggcctcctatggcccagtcaagttgacatgaattaaccatcacaaggggctttaggaatcatctgatccagccatctctccaaagcatgaatccctgtggctacttgccattaaaaaacctgaggagattcatgccacgcttaactattatccttgttttagcagggttctattaaattgccttcaaaggttaagtttagattaaaattagaaagagtatgaaatcacagcataagcattttgagaacaaaggctgctgctgacttctcaagttcctcccttgcgctttgtggtgctggcccagccaatagtgtgagcacaggagggcagatcctttccaggtcaagacaaatggggtttctgccagactccgacctctggcaggctcagtgcagctgcagccactggcagagggggaatgacctggggagaaagctaaaggccagtctcagtctatgaggcttgggttctgaatacagagggtcagtacctagggtccaaggctctccccttcccaggtagcagcatgactcttctgcccccatggctagaactgctctgtagcctggaagtgctgatgtgcaggattctgtctgcctttctaggctgcatttgacatccatttgaatcttgtttcactcttgtcaaaatgttgggaggaggaagagacacacaacaggattgactctgacattaagtactctccccacccccaccgatgctttccaggtggtgttttaggagaacattgtctcctttcctgattgtcatcactaagacctgagacacccttttccagcttctctgacaattagcctcagcatcctgtggaagctgtagagctctataaatattctcattcctgatattatctctgtaaaaaaggtgatatcattttggctaggaaaagtcagaattgctttgaaattttggtaaaaacattaagaaaaatccccaaattgaaatgtagatcaatggaagtagttttctagattcaccagttttctatggtgataatattactgtttgaccagtatctccagtgctgcccttacaacatcgtactcatgacgttaataagcacgtaagtcaggtaatatagtttaatttgaatggtcaagtgagaaaggcccaccttgctctttatagcaatctctgcagtggttctgttttgtaaatagggaatattaaaatttaccagaagttagctggggcaaggtaggcatcccattaaagataccaaaattccccaatgggcagagttgcagggaaaataatatctgccctttagaataggaggcaatagtgaaaaccccacccctgggctagcaatttgaggaacttcaccatcaggacattgatggctaaactctgggtctaactcctgggtgtttctgtgtatctatgatgggattcatctcacatccatgcactctctccagcgacgtctccatccatatatgcatctttgttcttgagagggaagtgtagaataggagcttggaagtgaatccctatgcacaagaccctgcttttcctctgaaccaggcaaccttggggaagacatggagtttctccctgaaactcttctcctcatctggaaagttgggtcatgtgaacagggttgttaggacaattaaattatataattattcaaatattctttttaggctactgtgtgttttacaaatgaaaggtattgttaagatcaaacaaaacaaggtagactttttgcactcatctgaatgcttcaccctctgattcactgtaggcagcaccaatgccctattactttttaaagtggtttccattcatgtttaagtcactagtttccattccagcaataggtcagtgagttaggggcagctaaaaatataactgcctgaacgaaacaaagaatcctccatcttgacttttactctttgtttcctttttgttttagaaaaccacttgagttggccaacaagcacccaagtgtgatagaaggatggtgggtttcacatctcactcccatcaaccataaatgtgtagcatcacacaagctctctgagcctgcctgcaggtgagttacctcacagcaaaaatttaaataataacattcacactgcagtttcttctgaaaacccctgttacatagtaagggtgttcatcctgccttacaaaatatactgatgccaagtccaagatcagaaatgtgctcttaatctaaatttaggaagattaaacaaagttggtgagcatccagaaaggtcaaaataaaacttgagtttgcaatataatgataaccttggagtatttcagactgtcagctcccttaagtggcacacaggttgttgtttgattggtgtgatgtcagacaaacctggattcaagaccgggttcttctcctaccagctctgtgatcttggaaaagggactggatctctgaaactcaggttcctttcatgtgaaatagacccatatcaagtctctcctcaagctgtccatgtgaggattagatgaagcatctggctactgttattattgtggaggaacattagctcaagccacctgcagcagacagaccctaaagtgacccccagatccccttgccttctggcattcatgccttatatataatcccttcgagtgtgaatgggatctatggcttgtttctagctaacagaacatagtaaaggaaagattttctgcagatgttatcaaggcctaaatcagttgcttttgaattaagcaaaagagatgctatcctgggtggccttactgggtgaaagctgctagaaaagagattcttgctagtcctaaaaaagcaagctactatcatgtgaatttcctgtgaagagggccagttggcactgtaccataggcagcctctaggggctgagggcctcaatcctaaaactgcaagaaactgaattctaccaacacccaccagagcttggaagaagactcagaactacagacaaggatgcagtcctagctgacaccttgactgtagcctgtgagatacagagcagaggacccagctaagccattgtcagattcctgacacgtagaaactgtgagataagaaaggtatttgttttaaactgctaaatttgtggtaagttgttacacagcaaagcaaactaatatacccctatttctggaaatcatttcctagagacaggcttgtattggaggaagatggggtttcctcacgtcccatctacagaactgatgaatgtagggatgagggaaggaaaagaaagcttcctcagatacatctgggagtgggtatgtgtgagcagagggttgctatagtagaaagagaggttaatgagacagaatgtgaggagctcaacactgatacttgacagccttgtcaaacacagctattggttgaaactgtgtgaatccataacaagatttttaaaaaattagactttaattgttatgttgtggatttgtgcataccatctacttcctaaaagactttaggggcactcgaaatcaaaacaacttatgatcatagcaaaaataattaacaagaggaaagatgggcatcagaataaggttgataaagggcagcgatggaagagaaagttgtatcaagagttccagaggctgtgaggcaagccccttccccactctcaggccattctaacctaccatcttcaatggtatcaggtgctcacacctataaagcccacctctaaatctgactctgccttggggaccttgtcctgcattcctgcacatcctgtgggatacactgtgatgccccacacgtaggagatgctcagcagatgtctagtgaaatgaattgttgacccagctcatttctaacaggcagcctttccagagaatgacagcgaatgtgtactctctgtgtttgaagactgtgtgatgttaattgaagtgcctgcaagtcaaaataagaatgacagtttattttaaaaaaatattttaatggggatcctgaaagtgaaaacaaatccttcacggagagattctttattgaagagaattttagaaagaccacagaattcagtcctgccccactgtgaattcaattccctgggtaaactacatagcgtgtgtttatgcctaacagatacatatgcatcatatgcatgggtggcctgtatgtgaatgcagaaatacctgtgtatttacactccagtatatctgctgtaagtctgtatcagtgtttctccaccctattttcattatcacctccctcaaggacgctttgtaaacatgttttccctaatcaccccttatatagacttaataccacagatacactgtatatctatttaagggctgtatgtatatatttatgccttatataaaaagagtgtaattttgtaccccatatgaaccaattttattacttttggggtgataattacccccctgccttgagaatacatggtctatatgtgcatctgtgtgtgtgtgcatatgtgtgcctgtgtgtgcacacacacacagacacacaaacacaagctaactgggcagaggtctgaaaagcattttgagatatttgaggagaggtttcccatcaataaccaagaaagcagttctggtccagtgattcttgtaggaaacagatgctagcaattagaaaactggaaaactccagttggtcctgaagcacactgggcatgacctgttttccaaatcttcagagatgggggagattttataaggccatatgagcagaaaacatctaattgttcataagaggaaaatttctgaaattctaatgtctacattgccattgcaaactatgaagttctcacatctattttaaagtaactgagcaaaatacattttggacaaaagggaaccattagcatgtttaatattttataaatatgatcactatggtaggcaagactttattcaacaatcaatcaagctctgaaactctcatttgcacctcgaaatgcttagctttacaaaaagagttgtaggaaatgtggaagtaaagatcaatgcatctgctttcaaatatcttcaatccaattttgttacaacataaaccagataaatatctgaggacctcaaatctgtgtgagttacatcaaccacaggacatgggagagaaaacccctctcttgctactctgagtaactgtagcactacaaaaacacagcatcattcaatcacatttctaaccctgacaaactttcacataacagaggtactgaccactttcacctttcctttttaaataaaactgtaaactaaggagaaggtaaaaacaagggccactagagtgggaacagatttgctaacaactgtgattggttagtgtacacttactatgtgcccagtactatgtgttgggcccaaatacacgaattctttctatagcaagccctgcggaaatcattcagcctctgttaaaatacatccgttcatgggaagctcaccacctttctcaagataccccattgctctgttggggaagttttattttaagaaagttctttgatgtgttaagctaaagttggcttctccacttaaaatcttaaaatcagccctcagcttttttcttgagattgacataaataagttgaattatttctccatgtggttcactaaaggcagggctcatggtcagcagatatccccaccaagaccacatcttcagtgaaggctgaccagatgggaattcaacaggctgagggtaaggataacagttaactgtcttacatgttgttgctcaggtagtgaatgacatgagtattaaattgggcatttatttacccgttgatgatagactggataaagaaaatgtggtacatatacaccatggaatactatgcagtcataaaaatgaatgagatcatgtcttttgcagggacatggatgaagctggaagccattgtcctcagcaaactaacacgggaacagaaaaccaaacaccgcatgttctcactcataagtgggagttaaacaacgaaaacacatggacacagggaggggaacaacgcacaccagggcatgttgcagggtgaggggtgaggggagggaattcagaggatgggtcaatagttgcagcaaaccaccatggcacatgtatacctatggaacaaacctgcacgttctgcacgtgtatcccgggacttaaagtaaaaaataaaaataaaaataaaaaattgggcatgtattacccaacaccatgtctcatgagtggtgaaagaagcagataaatctgggcaagtaaaggaagtccactgtgtacagtgcccacggacctacagagacagagggtgcccagtgcctacacctttgacctccctccaaccactgctgaagcttccttgacacttcctatccttgacagttggttacaattatgtctgctcttgccctcacccattcactctctcaccagaaaataattaaagggaactaatatatttataaataacagtccttttcctttttaaattttcatataaacttgggaaatgtacagtgaacaagtactattggtatattctcaatattcaagcctattatagtgtccaggaaaagggatgggaagaaagaattaaagaaagaaatgttttttttaaaaaaaacctcaaggtggccaggaacactgttccttcaccccagataccaggcaggcccctttggccactccttaggagagatgataggttaggaacatgtataagctgtgtggccttgaacaagccacttaaccattagtgcctcagtttcctcatctatacaatcctaataatagtatttaatacatagagttgtggggattaaataataaattcacataaagctattagagcacacatagtaagcatttagtcaatgttagctgtcattactattattcttttcccttgaaggaggctttcagaaatttttataacttgatttcactcagtgagaagccttcaatttggtaacagaagaggggatggagagggaggagaaagaactcacagtgtgatctgctttacgcaggcctcccaaggctggcccagcaactcaagataattctgtgttcatacaagccctacctacaatactgggttgacatttctgttttctctattaaaagcatcccaaataatgtactgaagttgtaaaataaatctttggtgctaaatatcctaatgagacatttagaagcactcaaattaggtgttacaattaatatcataggatctataagattcaaaagaaaattccatttattttttttctaaagagataataatctgagactggataaagaaatgtggtacacatacaccatggaatactatgcagccataaaaaggaatgagaccatgtcctttgcggggacatggaagctcaaagccattatcctcagcaagctaacacagaaacagaagaccaaatgccatatgttctcacgtataagtgggagctgaataatgagaacacatggacacaggaagtggaacaacacacacacactggggactgttgagggctggggtggggggagagagagcattaggaaaaatagctaatgcatgctgggcttcatacccaggtaatgggttgataggtgcagcaaaccaccatggcacatgtttacctatgtaacaaacctgcacatcctgcacatgtacctcagaactaaaaaaaaaaaaaaaatagaaatgaaagaaataatgatctgggctcttttttgcaaaccacggaactcactctagctaaattaagcaaaagagaagtggggttagaaagccagttcttgatattagccctttgtcagatgagtaggttgcaaaaattttctcccattttgtaggttgcctgttcactctgatggtagtttcttttgctgtgcagaagctctttagtttaattagatcccatttgtcaattttgtcttttgttgccattgcttttggtgttttagacatgaagtccttgcccatgcctatgtcctgaatggtattgcctaggttttcttctagggtttttatggttttaggtctaaagtttaagtctttaatccatcttgaattgatttttgtataaggtgtagggaagggatccagtttcagctttctacatatggctagccagttttcccagcaccatttattaaatagggaatcctttccccattgcttgttttaatctacaatgaactcaaacaaatttacaggaaaaaaacaaacaaccccatcaaaaagtgggcgaaggatatgaacagacacttctcaaaagaagacatttatgcagccaaaagacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacattgttggtgggactgtaaactagttcaaccattgtggaagtcagtgtggtgattcctcagggatctagaactagaaataccatttgacccagccatcccattactgggtatatacccaaaagactataaatcatgctgctataaagacacatgcacacatatgtttattgcagcattattcacaatagcaaagacttggaaccaagccaaatgtccaacaatgatagactggattaagaaaatgtggcacatatacaccatggaatactatgcagccataaaaaatgatgagttcatgtcctttgtagggacatggatgaaactggaaatcatcattctcagtaaactctcgcaagaacaaaaaaccaaacaccgcatattctcactcataggtgggaattgaacaatgagatcacatggacacaggaaggggaacatcacactctggggactgttgtggggtggggggaggggggagggatagcattgggagatatacctaatgctagatgatgagttagtgggtgcagcgcaccagcatggcacatgtatacatatgtaactaacctacacaatgtgcacatgtaccctaaaacttaaagtataataataaaagaaaaaaaaaaaaaaagaaagccagttcttggcttctgccttgaagatgctgggcctaagaagcgtgttcaaatggcactgggtagcaatgaagtaggacgaatatctactacatacatcaataacaaaatcagttaaaaatactcccaaaatacaaacatatgaatagtgggcaaaagtgccctttattgttacttgttggcaaaagaaagaaccaatttcctgccagatcatggcatttgagactatggaaaaaggcctggaacatgaggaaattaggcatgcacacacacacaatgaaagtggctaatgtgaaagttaaccaaagtaagttaaccaaagccagagactataagtaggttccatgagtttatacaatctgaattaagcccaggacccagcaggcccaggaatgtggttccatctgtttcatggttgaaaaattccccagagaggccaagtgccttgatcaagggtgtaggggagtcaagagcagaaactgccctgagtgtttaccattaggaatgtgtgacctcataagacagtattctcctttctcaggtaatctgtccttgggagcggttgtctggggcttcacagaatggctttcctgcttgaatggcttggctaactcacctggtatgcaaaattggtttggaaatgagctaatcattatatttttcacacggtgacatcctggaaagacctgctgtgagttcccactagggaagtggaaacttcctagctaccttctcataggcaggtggctatgtcccagcacacagatgttaggacactgctcagaggagcagcatgtgtcagcagcacatggcttggcaggagccaggagtctaagcagtaaatatcaagggaatgatttgtcagaatagcaccccaagtgcaggggaagtgagaggaggcgtagtggtagaattagggaatgagttctgtctacatccagggcttccacctgaggactcgagtccgcaaccacaaaaacctttctatggacctggcaacaaagtcctaagcttcagcccctgtgaatatttcaacacatgcaggataggaatattaataacctggattcacatcagaatgttctccaagtaattcagaatgcttcattttacagctcaaccctgaggttgccagatctcagtgcttcatggaatggacagtgacaggtgaatatggccactctcactgaaggcagctcctccaacctcataaccatttacagcaaaggccaagcccacagctccaggcatcatgccacattcgttcaattccttcttggaagggtacctaggtcagcgatcagctcacacctgtttttgtagatgaggtgttactagaacacaggtatgtccatttgtttacatgttgtctacagctgcttttatactacaaaggcataactgggtagctgcaacagagactgtatagcctttaaggtctaagacattcaccctgtgactctttacagaggacatttgctgacctcaacctaggctatgagagctccaaggccattcaccaagtatattgtaaactccctgagagcagagtccttttggaacctcccatgggacctcacacagtgaggtacacaagagaatcaaagaatcaacttttagagctgaaagggacctcgggtatcattttatccaacccttttattttagagatgaagaaacccaagctgccagttgaaaataacagaatggcagaaagcagaaccaaaaatcaagtttcctaaactccactgtaatgctctattacttgacaattggtgaatataaaataaatgaaaagataggtatggatttacacaggaatatcatttgctgggtatatggtgtgtgccaaatactatgtggatgtgggtatttcagttttggacctcaaatctcaggagaaaagtgtatgtatacatattatatatacacataaaatttatatgtgtatcctgtatattatgtgtgtgtatacagttgacccttgcaaaacacaagtttgaactgcacagatccacttatacatggataagtataagtgggtcttccacctctgtcactcccgagagaataaggccaacccctcctcttcctcctcctcttcctcctcagcctactcaatgtgaagatgaggaggatgaagacttatgatgacccactcccacttaatgaatagtaaatctattttctcttccttgtggttttttttttttttttttttttttgagacggagtctcgctctgtcgcccaggcaggactgcggactgcagtggcgcaatctcggctcactgcaagctccgcttcccgggttcacgccattctcctgcctcagcctcccgagtagctgggactacaggcgcccgccaccgcgcccggctaatttttttttttgtatttttagtagagacggggtttcaccttgttagccaggatggtctcgatctcctgacctcatgatccacccgcctcggcctcccaaagtgctgggattacaggcgtgagccaccgcgcccggccttccttgtggttttttaaataacattttctgttatctccttactgtattgtaataataccatatataatgcatatagcctacaaaatgtgtgttgactgttatgttatcagtaaggcttcccatcagtagtaggctattagtagttaagattttaggaagtcaaaagttacacatggattttcaacttgtatggaggggtcagtgcccctaacctccacgttgtttggaggttaactgtatatatgtaaaacacacacatactgtgtatgtctgtgtaataataagatgatggtgcacatgctcctttgaaggagacacccaccgtgaggggagtatccatctgatttgtgacttcagggtcaccatttttagttgttaccacctgttcatctgaacccaggtgatggaagtcagcaccaaaccgaaggagcagagccatgcatggatggtctttgtctttcatccctggtgtattggtttgttttcatgctgctatgaagaaatacccaagactgggtaatttataaagaaaagaggtttaattgactcacggttccgcagggctggggagacctcaggaaacttacaatcatggtagaatgcacctcttcacagggcagcaggagagagaatgactgccagcaggggaaatgccagacacttatgaaaccatcagactcgtagactcactcactatcacgagaacagcatgggggaaacaacccccaagattcaattacctcccatcgggtctctcccttgacacatggggattattacaattcaaggtgagatttgggtggggatgcagagccaaaccatatcacagagcctctttttccagctcttcattgaccatcccccatgtcacaaacctcttgtcaactaggtgcatctgataaccactctttgaaatgaagtctgggtattccttcactctacagtgttcaccaacaaggcattccctttgagaggcatttttctcccactctggaatgaaagttgcctcgccctagttagagcaattcttggcatacagatggaaaatgctttctgaggagtgttaggcctagataagcctcttatcatcctttagggtgaccttaactgggagaggaaccagaagagatagtccatggtttttctccagcagtgtccttactctcctggggtaggtgggtaccaagagaaggtcctggggtcttgactgggtggagagcctggtgtccccctatcacctgctctggaatctgccctagcaacaggtctacgggggagagaggggaagaggtggatggctttctcccccttctctgcctgagcttagctgggcctctcccctcatgttgcacacttgaactgaaccccaacttcttccctggctgtgctgcaaaacactgcttagtgccttcctgataccaggtcccttggcttggagctcccatagcctcattcttgccttcaggccacagtccttccaaatgcccagtggctgccactctcccagacccccaggctgcaagttctgccaggtcccagctggcttcccccacaagacccagggcctggcacctggtaggcttcagtaaacagctgccacatggaaaagtgcatttcaagtaccttgacttcattttttattgtttttaattatgaacacacattaaagggttttggagttagtcagaaaccccaactctgccactttccatgggaccttgagcaaaacacctaacctttctgaagccagatttcgcatgtaaaacaatcacaatatatctaaaggagtagggatactggattaaacagagtgtcaccacaatatctggtgcataggagagagatgctctgcaaattatatttattataatgccttccctgatcctgctacccttgaccatggcaagtgtctcagaaagactcagaaagtcctagcagtgaggctggaccacccccaccccccacaccagggagtaaactcaatcagcagcagctttattctcacctctgctttcagtcttctatgtggcattataacagcctaacttgtctgggcctcaaggaggaatgaagctgctagaatcctgcgaggactcgatggaatccatcaaattccatggacgatattgtaaatttctttagatttattgttatatctcacatttatagtgcctagtgaatagtctgtaattttttttgttgttgttgttgttggactctgccatacatatctgtaaatgactctaggtcttagaatggaagaagagccgactggaatagatgtaagatttctctcaagtcagtggcttcatccttgcaaagatgattttcagagcttactctagaatcctgactgaggaacttgggccaatgccacatcttgggcaaactggccaggggacaaaatctgctcttggtggccacacccacaatgcacaacaggtacacttttttttcccagtggcatgcaatactcctggtctctcttacccacttccttctggtcctcttccctctgcctactgacctgataaagtaatcccagataatgtgtcagctggggctactgcatccataggtagcccattacaagtagcatatgtatatttttaaaaggacgtctaagaaacattccttaagccaaaggggttgatcaaagaatgggagttcatgtcactatggcagagaagtgggtaggagacttgagaacaggtgcgtctttaggctgctctaactcacccaatctggtaattgccctgctttcttgtctaagtgttgggatctgaccttgaccttggactattcattgccacctatggagaattaaggaaaggcaaaaccttggtcatctccctcttgctcgccattgggaaaatgccttctgatttagcgcagcaatttctcctcattaagctacaaggggctgggtaaaatgaggcaggagagagcacaaattctgatgtcaggggatgaagtttgaagccaggctctacaatgtcctagctttgtgcatttatccagatgggactcagtctgaccttcagtttcctcatctgtaaattgggaatagtaccaagacctactccatggaattcaaggaatcagcgaaactaaggtgttcagaatagcagttagccactgttgctattattcaatttccaaactgattctctgattttgaaaatgcaaagacaccactcatgggaccaaagaggactgaggtgtgaagactggtttttctgtatcataagccacttcagtgatcctctgtctcacctacccttttccctcttccatccccgctatctctttcccaacattttcctcttcaagaaccttatactttgaggatggggataaatacctttgcaaaaacaacaacaacaccaacaacaaaacaataaacaaggctgcaactgtttttataattccacgggccatggagcagatcctaagtctaaaggtcactatataaaatgactgagatgttatataccttggggtgacctgagagcagtagaagaccactcgcctaccaaatctctcctacatttgaatgtcacagggctttaaatttccactgttagactcacccctgtgggttttggatactcccatggggcctggttaggttaagggcagtgttcccttaaccagactgggcacaagaatcacctgcagcacttgttaaattacaggtatctgggacctccttccctgaagactctgattcacacatttgggctggagtttggaaaatgccccaggtggttctcatgcctgtgcaaggctgggaaaccctgttctggtggagagtggtcaggtctggagtccggatctccaggtttctaagtttgtatagagcaacccatcatgcagcccctgacaaatcacctggtatatgagaggattaactatcttccttcctcaaaggataagagacccaaaaatgcttcaaaaaactgtatgtacacacaaggaaccattttaacagaatatgggaaataacgctgggaaaaggaatgcaagaatagtttcagtatcaggtggaagcagttgaagttgatctagcagatggggaatcgatgtcatacaggagaaggttcttctttaggaagattaagtggacagtattaagcatggtcaacaggaggtgagagaggctgcaggtgggatgccagtttgtagtaggaaacaagaatacataacttagtttctacggtagagactagctccaaacctgcttcctctctgtccttgcagcacagttagatgacacttcccagcttcccttgcacagaggaacagccacaggattgagctctggactatggaaagtgggtggaagtgattcgaccatgcaaacctaccatgatgtcctccaacttcaatcttccctgtgctggctgactgtagagagcccagcaaaggagttggccgtcccgcagggtggcagaactacagggtggagggagtccaagtgggggagaccactcactaaacactgcattgagctactgtgtgaaaaagttggtaggttgttgtttcagcagttgacctataccgaccaaggcagtgcctgacatctgaacagtgaagactgtagtttgcaaaaggggttcatgtttcttatcttatttgacttcataataataatcctgccacacagatcagatccctgttatattcacaaagtacctgaatgaggaaaggccacataactttccctacacagctcccctctcccagagcctgtggggaagccctgcccagaaccttcaattccacaagtaaaacctgagtcatttgtgacaaagggccaaggacatatggctcctttggtttcaggggcaaattctaaagacactgctgtctctagattttatgctataactataaaatgccacagagagcaaatgtgtaaatgaataaaaggcaggtgagacggcccctcgtcttcatccttggtgttgacggggcccatgcacactggcagcattaggaagcagacgtggacattgacaggagaggagccttgggctggatcaagaaacctctatctgttgccatgacaatctcccaaattggatgtttaagagaataactgggacatggtgttacttcgtctctattctaggtaatgggttcccagttggactccattcactgcacatcctcccctccttccccttttgtgttatttctccagtcggacacttgtttcttttccctcttaccatagaataacgttaaacaaaagtggaaaagaaaccatcaccctgaagtccatagaggttgatataggatatggggtaactggcacaaaacttctacacaccaaagcctgtgggtaaccagagacgtgctgcaaaggcctcccacgccaaaacaccctgcctcagatgcagggccaaatgcaccatgtttagataattaagcacttccctcttttaaactacaattgctccacaggcaggtaggggcacagcagtcttccactttataaacaaaagtctggatcccccagcttgccatcagagatgcttcatgatctgatctgctagatctgaatgtttgtgtccccccagaattcctatgctaaaatttcatctctgaggtgttggcattagcaggtggaggctttgggaggtgattaggtcatgagggtggagccctcacaaatgggattagtgttctcatgaggggctgaagagaatagagttatcctcctccacaatgtgagaacccagtgagaaggtgacagctatgaaccacattgtggccctcaccagacaccaaatctattggtgcactgatagactccccagcctccagaactgtgagaaataaatttctgttgtttataagctacctagttcatggcattttgtcatagcagctcaaagagattaggacagagcctatgtgtgtatatatatatatatatatttatatatatatatatacacacatgtataaatatatatacatgtataaatatatatatacatgtataaatatatatatacacatgtataaatacatatatatatatatatatacacatgtataaatacatatatatatatatatatatatatatatatatatttagatggaatcttgccctatcgcccagcctggagtgcaatggcgcaatcttggcccactgcagcctccgcctccttggttcaagcaattctcctgcctcaacttcctgagtagctgggattacaggcatgcgccaccatgtccagctaattttttgtatctttagtagagacggggtttcaccatattggccaggctggtctcgaactcttgacctcatgatctgcccacctcagcctcccaaagtgctgggattacagatgtgagccactgcgcctggcccctaacttacatttttatctgccttcccaatatccattcacaccctcttcagcacagccaagcagagctctgagttttctgggacacatccgggcttgtcttgcttctgagccattgttcacatgatttcctttgcctaggacattgcatttatttcctacctcttattccttgatcaccttggctaactcctcacgtgcctcattcctccctctcaaatgatatttcttttttttcctttttttttttttttgagacagtcttgctctgtcaccaggctggagtacagtggtgcaaactcagccctctgcaacatccacctcccgggttcaagcgattcccctgcctcagtctcctaagtagctggggctataggtgggtgccaccacacccggctaatttttttgtattttgctagagacggcgtttcaccatgttggccaggatggtctcgatcccctgacatgatccccctgcctcggcctcccaaagtgctgagattacagtcatgagccaccatgcccagccccaaaagacattttttaaagcaagtccttatttctgtacttcttctccatgctccctcctctggggaacctcctccgtcacctgtagctctgagcagaagttcagataaaatccctagccctgagcccctgtgatcctcagctctgatccttcagcattctaaggaacatctgcacaggactggcctgccagcacttcagattacaccattccaaatcaaacgattttaatgaacagcaactcccttcctcacaggatacataggctttcttcagagttaaaaggaaacttaaagctcaattagtttgtctgtactcttcaatttacaatatcttagacagtaatggtcaagcccatcaaagatatcaccattctagatgtggacactaacctttccaggggtgaatgtaccaggaaactgctgagtcttcggtgttggtgcccctaatatacactatttgcacaggcttcttccaaggcatgcacctaattttgtattcacttctgtattccacaacacactctgtcttttggcccttgtttggactcacttggcctcctgatgggaccactgggatagcctcctcactgacttctgcctcagggctctccttattccaacatggtcacagtgaatgcagccgtaatagcaatggcaaaaacagcagcagctcacattttatctcactactcttccttaaacccacatagcgtatatcccaaagtgttagattgggaacttatctcatcagagaaggtcagactggatgacttctggaagcttttccaaataataaattctatggttttatgaatgttgatcacattttatagaaaaaaaaaacttacccttaaagcaagtcacgcaaccagtgcgtggcagacctggaatccagatcttctttcttttgtttgtttgttttttcctgttttttttctttttctttttttttttttcccgattttcatttgcacaaatttatggggtacatgagcaattttgttacatgcatagattgtgcagtgatcaagtcaggacttttagggtatccatcatactttgagttcattgattttcccactaaagcacgaagtccagctatcaatctttctaaacataacccaagtcaatctcctattgtgtgtagacacttccagttactccccactacttacaagggagcagataccacttacctcccattcaaggccccctcctgccactgttgttggcttttttgctgtcctatttccaattgctcctttcatataccacttgcttcagacaaccccgtgtactcataagccctgagcatccccatctccacacctttgctggacctgacatggttgctcacttttggccacctctgaatcctgatcattcttcaagactcaactcaggtcccaccctacccaaagctgggcctgaagacaccatttgggccacactggtcccatcatatgcatgactcattgcattcctgtcactcatgtgccactgatgcttgtttgcattgcactcctcagtggcactctcacaagctactggagcctgtcttcttctctgatctcccccagcccccttcagctttcacagagcctggcacagagtaggtgctctgtaagcattttcatatattgattgattgattatattttatccccaactccctacattctttatcttactatctccttcatgcattgccatttaaaattatgtgtcactcctatataataaaaaatatacaaaggaagaaaagaaaaattacaaaagaaaggtcaaaagcatttctttcctcccttttctggtttatttgaggtcaatctggagtgattcatgtgaaccagcatattgccttggctacctccatcctgtgaaatgcttgtttgaagtagcgactggaccatattttgtccttttgatgctccactgagtagttcagccctatttacccatggtttgcaccagtggttctcagtctttgatgggcttcagaatcaccagtgggtagcttcttaagcatacagatgcctgggcctcaccccaccctcctaaatctgaaactctatagacaggacctgggcaggtacaagtgaagaaggcaagtgcagtgactctttcatgccccaaaggctgagaaccaccagcctacccatggtttacctccagtgctgctggcatgggaagagtctttgaatcccccttaaagactcttcccatgccagcagagctaaaagaacttctagaagttaacaactccatttctttttacagggaagaattcgtttcagttcagacagtaggctatttatcttatttgtccttaaagaatttcacatctcagaacttagatacttctttcttgaaagaaaagacacgtttccaaagcaggttgtcatttagcgaactggaagagaaatgtccctgactgtgggagctgacccctcagaacacaagcagtgttagatttaagacaccctgggtagagagagtcctttacagaactacatcttaggaaactcatgcttaaccactttgcatctttactatctctagttcctccagtcttgacaacagatacaactcaggatgtgttctgggtaatagttttttaatagataccagagagtgagagcctacgacattttccccataatcctggtagataatacgtgtgcatgtgtgagtatatttgatgagagcacctatggctatgcatagctggaagattgttgaggaaggggtagtaaaatctgcaaagagaaccagggatcctcttgaaaataaagaggatcctttaccctggcctggctaccaggagccttggggaagcagttatgtaggagctttcttggatgagggagcaactgacaggaggaatcaacttcccctgagtttgaagaacccagtgggtcagggatctgcagttaccctgtagtcagtccaaccacattactccagacatgggctctagtgggctccagcttatggagcagcagtccagtcagaggcagtcagatccagtggtggttgcactgtacttcagttgccattggtctgcagcaatgagactcactgcttgtgttctcaggggtcagctccaacaatcgggaacatttctcttccagttccctgaatgacgacctgctttggaaacttacattttctttcaagaagtatcttggttctgagatgtgagattcagctggtaggactgagcctctgacttcttgtacacatcaagggagggaagcccaagggctttacttttacttattgggctacatggagcctacagagaaagacttactaataggccagatccatactcagcttgaaatgctgacaccaactccatgaaagatgtgctgctgctattagcactgcactggttaaaacaaaaaaaaaatctgtggtccagagaggtcaagcagcccatcctggccaacacactggtgaacccgagcctgacaccaaagtttcactcttccaccacatctcttgccaccactaacatggggccagcagctgacaactcaaagggaaccaagaatgagaagtttttgacctaactgactgtctaaattgacagacgctttgtcttgcatggagggggccaataaatgcccaaagagacaacacaagtcatcagggatgcaggagctctcaacactggcagtggacgtcagcttctgcagacccagtcctcattcccaccaccctgccatggcacttcaaatatgcatcatacaactcttgacgctagctctccagggatgtgttaccaggagaagaagcactcactgccatagcagggcaggcaaatttgtgtattgcgttattgactacagatcaaaacctgaagatagtgggaaagaaaaacacagtagcttaatatgatgaagggaactttaaaaacctagtgagctcatgcttaggcaagcggcccaaggtgaccaggcagtcacagtagctcagggacatagaggcgacaccacaagatctgatcctatctgttctggaagtcagatgaccacaccacgagtcaccacaacttgtattgcaccctgcaccactcagaaacttttgggccactcaataaatgaaagactagtcgtttccatcagacaattagcagaactctgttttacttcccccatgctgaattgatgattctttgactagaccaaccctatacacgattgttctggagtcctgtggatagggcttaatagttcgtcagcatctgttaactgggcagtgattggatgcaagctttctatcaacaacacttctgaccgtgatgccctgaggctgttagaagttctggacatttaatcagcattagcaaggccacctatgtcagcggtggcagaagctgcctgctattggacctgcctctgattatgactcagtggctctccaccagggctgcacgctggagccacctgagagtggatatgaaaatattgtttcagggtcccacccacagacacactgatgtaatcggcttggggagcaaactgccatcagaagttttaaaatctctctcaatggattgaataggtagtgaaggctgagaaccactggtttctgttgaaacctcagttcctggctgaagagacacttgcggcgagcttgtctgtatcattagtcacttctggggtccaggggtgagactgggagtggaggaagcaatgcaaatgggtggaatgccttgatctaacctacacagcacatcctgtgtttgtcttttcaaattgctttctgttttgcttttacttccttgctctatttctttcaataaaccacactcactgccattacctctagcctgttgtcctcctcttaggatcaaagtccaagctacatattatctcatttactctcaaaatatccctgcaagtgaggaaggagccaggcctttgttccccaaggcaaatcagggacgtgcaggtccagaaaggttcagtctgccatgggactcataatattcaagtcagtgtgtttacagcaattttcaatttacaaagtgttttcacctatgttctcccatggaatcctcacagcaaatctacaatgacagtattttcataaccagaatgaccacacatccttatttgctcccaaactatcctgggttatacctgtggttccagcctaattattgatatcattccctttcactctcaaaagtgtctagatttggacaataaattatatggtctccttatttataaccatgctcttgttttaagagggccagtgaggctcctgaaagttaaataatttgttcaggatcatttagctaattagaggcagaggcaagacttgaactcaggtactgcatctccaaatccctgcgccatccacaggtattatgggacattagaatcagagttgacatgatctaacatttcttattgtagaaactaaaaatgtggggaaataatctcttaaaagtcactgtcagaatgttccccgaaagggaaagactcggagtacatagcagaaatgggttagtctccttggaagcattctatgaacacattagaatggattaataacataaataaatgtcaccatgatggcacttgaaagcctaacttggcaaaataaggtatcaggcctgacatataggtatttggaaaagagcaagaaattcaaagtctaaactgctagatttgaggactggatctgaatgctatctgccatctacctttgggcattttacctactttctgtgagcacatgtattgttcaacagaacaggaggaattatcattcttagttccctgggctgttacaagaagagcaaactgcagctcatcaagtgctctgacagcgagtctcataaggtacctgtgaatccagtttatttgttttctttatctttcacataagtgaatcaagccttataaagttgctgatgatcaaatgagataaggtatttgaacatacttattatgtcctaatatgctgcaatctttccttcttcttatcattatcattatcagcagtagtagtaacagataatgactatcaattgacgtgggagacaattacaattacatgtcattgtgaaactcattaggtgactgtgatttagagtggtacacccagtggaaacaagaggttgggaggtccttccaagggggtgttgaaaatgaccaagtcatgactataactgggtgggacccatccttcttggaagtcttcatagaaaccaacccaccctgccctgcagaaagagcttcagttacctgacaccatcaacaagaaggcctttctttttatggggaatcatgtacctcagagaaactccaaactttggaaaagtgtgattctgtcaacaaggatattgcttccctcaaatgacacagttcaagtaaggcctgggcagcatctttatttcacaatatttctagcctttacttgtcccatttacttgtaaatgagaactgctaacctgaagctcaaaaagatggggttgagggaggagtcaaaacaactttcatacctgatgttttgatctccccatcaatctggtttttgagctagccatgaaggcctgcctggctctcattgatttcctttagggaaaaaacaaatgacaacacagtcattttagaattatttggggaacgctgcaaattgtgcagtaaggtttttatataaatggagagactctccaacactgccaacaagaaaattccaaaggtgcaggtagaatcggtctccacacctaggagtggggcaaagggctcctttggttctaaagaacctatttgtgtttcaaatatctttcagaaacttgacaccttgaaactaccactctcaaggaatctgagtaagtcctagaatcgctttcttcaaggagagcagcaagactcatcgctttgttaaagctctccctattcacccctagggcccaggcctggatgctggggttcagaacacccccttgctgccctaaggtccaacactacccagcatcagacgagaaatgacctcctttattacctgggtctgccaaaggacctggaaatccagcctggggtgggggtggggggagtcccagaaaccaaaggagcacacaggggccacagtgggaagagaacaggctgaagaaagcaagtgtcactaaatgtcaggtgtaagcttgaaaaataaacacaaagaatgtaaaacccagcagaagaaatttaacaaacctttgtggtaggctgggacaacggagacagatcacgtaccaagtgtaaagtaagtcacattttaagagtcagaaagtaccaaagaccacagattgttatcaaggtttatgtagatctcatactttttgcaaacatctatttaattagcttgtagagaaggatcttttgggcaaaataacattttcccaattccagggaatatttatgccttttaaattctgccaggaggcccctgacaggcaccagtgactcttcccttctcagcgatctgcatatttctagggaaactttgcactgagagagttttccccctttgtgaaaggtcttggcgcccaggcagtccccgacttcccctcccccaagtcctggcgactgtttctgctcagccctggaggctactctcccgcagcctcaggtttccctacttctgcagcgtcggcaccaagggctgatcaaatgtttctttctccttacaccggcggaccgggaaacgccgccgcagcctcgcctccatccttcctcctacaggttgcaaataaagtacagcagctctgacattaggcagtttctgtccaaggagcaaggtgacttcatttaatttgcactgtgctccttcatccctgtctgcatcaggttgaacgggaggctctccctactaccaaacgcctaacatttccttgatactgccttgaaaaatcatgattatgacaaaaataataacgtcggagaatggagtgcttgttttctgctttgcaagtcaccaagcaagaaaacacttttgtctccttggcttttattttaggatctctgagcgaaagagagaaagagaattttaagaaatgtcattttcgctttgccaaagatcattgtgtcaataacgtttctctcccattcctccccctcctcccgttttaaaggaaaggttcacgggtccagccaggtttctgccgcatcccgacacctggagacgtctttcaggaccagcctgaatcgcgtccgggctgggctctggactcggactcgcagcggtgacagcggaggcggggacgggggtggacaaactgcggatcaactctccgagaagacggccacctgccggaacctgccttcctccattccgcccaggagcctcgcagcggggcgctggcctgcggaaaggccacgggggagcacagggctccgcgccgccctcctgggagggtccggagtccagcgcaccccgagccctggtgggtgagcccggcgggaggcgcggcaggtgcggcgggagactggaccccgacctaccttcacaaagagctcgatctcggggtccctgtcgtccccgttagctgtcgccgagtctgtcatgccgttggcgcccggggctaccgtcccgggccggggaggcgccacctctgcagcacctgggccagcactctgcgctcctgccgctgcccagcggggctcctcttcagggcggtgtttaatttttcacaaaaccatctattctccagcccgagcagcggggtctgagagatcagtgtcccagatgctcacatgaaaaggagcgaagccgggaggaggcggggggccacggggaaagccgggttaagggaatgacaacaggtcgtgggagcaacaagtgccgggctgcccggaggtgtcacaggatccgcgactgtcagcgatcccgccgccgccaacgcgcccaaaat

SEQ ID NO: 200 - DNA, 117421 bp, Homo sapiens
cttttgtaatatttgaaaataaaccaactttatttgaatcagtcaataccaatcaagactggaacacaaattggtaattggttcagattcatgaggaaaacactcagctgtatcttcattaaaaggcattttacatttattaaggcttgaaagcaagtcctgttattcatcaccatagttaaaggtctcgagaaaatcaagtaactatcatttggagtgtctttgtaaaatgaaacacttgttcttttacaaaagctaagcatcttttgttaagctagttaactccccagcttataaaataggacaacgaggtggccaggaaagtaagacaaattcaaacatcagctggataatttatattttaaatatatgtatagtcaatattgtgaaatctctaactctacataaaatacttcagatgactggatccttaaaagtacattttaccaaaaacagattgcttctatagaaacacagaatagcccaaaccttatattgaggcaacgtattttatttatttttggttgcaagaaaggaattggatctatttctttaacgttaaatgaaattatgcacactttggatcatacataattatgaatcgaaagtatcctgacactaagctgggagatgcatactgacaaaggggaagaatgtgtgttgatgaggagggcacatgttgcttgatttgaatgataaagagaaatggatagaagacaatggggctgtgtgcagcaggtcctgttcgcttaagttttcctaacatcagaatcagggtgcttcacatgcacatgtctttctctgatgctttcttaagattctccttaatgtcatttaaaaaaataagaaagtgatcccttgggaatcattgtacttagttttaaccatgagttaacatttcctttttccaaggaggatgacaccagcatcttgattcaccgtgcagttgagatggcccctggccagtgggaattgaggcgagtcacagaagtacttaccaaatactcacctgctgcttctagtttaatttaattttagacacacactctcacagtgatgctaaactctttacaagatagacccgcagcttcctgcctctgcctctctcttagttctatttgtccaggccttgctgatttctgggactctcatatggtcaagatctatttcaggcatgacctatcttatgacagttctaagatgcttggtattgtctgtctgtggagtggccatggggcacagaactgtgaagagcttctgttgtttcatttgataagggcctggaaagtcagcctgggaaaactcgcacttggtgtggcctttttctgataagatcaagacttcactggccccaccagcacaagaagggaatgctgaggacagggccatttcccaagataaaactagtttgggatcgtgtggccaaataagctgatggactctgtttccgacatttcagctcatttgcttagtgctaggtcactctacctctcgtttaaaagaatatagctatgctcacatctgtgactctgaatttatcaagcatttgactttctttatcaggagatgaagaaactgtgctttggatccatcatgattttacttatccagcttactttttacagttattaaaatcttactcaataccttctctctgggccaaactcagaagcaggcattgctgactagacagtgaattcaactcagtcattctgagtttgactcttgcttctgccttcgtctcccactaccctgcttcccccacccccaatagtgctgtgcaagtcaaagaagataaataaatacaaaataaaataagatctcaacacaaatacatcccctttctgtgccaccaaaatgctttctgagcgatttgtattcattcaggaccaatgaaaaggaagcctcctaccctatagctgtatagttgtggggtcccaactgcagaccctcccgtgctccctgagttgttcttgggacacctaaggacctcaccacactgttgctgagacatgatgtgctgcacatatgataagaaggccagacaggctgaagcatctggagaaagatctcttttgaaacaaaaaaaaaaaggaaggtaatattaatattattgttactttaatataccataataaatctagtcataagacaccataactaactcttagtccatagtcacttgcattatatgataatccagtgctgaaatataaagaaatttctgaattaagtacccagaagtgccttccttctgtactcctccctctctttcaaatggctatcattgatcatataacacccccacctccttgtcttaatatatttatctctgtaaaactagctcaaccacagaagggacatctagaaacagcaatattgatttggtttggcctgtttgtttttaaggactttccagttgctgaattctgaacatccaatccgagtccttggaattctgcagacttctctggggtggagtggcctcaccggaggcttggttctgttttctctgtggcaattggctatgattcacagatgtgtttccagaacagcccaactgtgggtctcagggaagtaaactgcctcttaggtcatcctgcctgtgctgtaaattcggggaaggatttctgagtacagcaggatttcacactaattaaaaggccttcgggatcatttcagccctcatcccccaggaggccagtttggggcttttccctacagtaaaaaaggactctttcctcaccagttctccttgttaaacatctccagggcacaatttccagggggacctggaaaggttccttttgaggtggaaatgaatcaactcattccgccttttcaaagctttctcaggcttataaagtgtcctactgagaaagttcctcttcctcaatgggctctaggagacctcctgcttcctctcctctgatttgatcaatgggttactttttttcttcagagatccctggaggcaggtaggtccagggattgcttgggttagaatttgttgatatttctatggaaaggacccgtgctatcctgcccttgctgagaaatgagccaagtccaggggctttccagcacttgggagcctcaccctttaccagcgaacactatagaagggggattgttgaaggtaagggcctgtggcaaatggattttctcaccgggcgttcactgggagaaggagttgatgagtgcatttttcttagtttcctctgcacaggtccccaagctcaggctgggtaagctttttaggagatgaaacttaaggagaatgacaaaagagtgaaatattagcttaaaaatttttccttttttttttcacctggcagttgagtcagattgtaggaaaattaacccagatgggtctacatttttcttcaagttcaaaccacatggtttcctagtcagaaagtctcatggactttcttcctaaggtgttctatgatcagaccacctcctaaatgtggcttttacccattacaggctacagttgaatcaggcaggagcagctgctggagagcacccagccgacagacctgcattccagaagcagcttggagaaactgggaagacatttttgacccattcttgggtttttactgtaaggttagcagttacatgatgccaccagtccaagacttagatcatgagagaaggcctttttaaaagtttaccagggaacatcgaggctcataaagaactcttttgtcttcacccatctctcctcctcccactcccatccactttctcatagctcaaaaaccactcattggtaagcacagtcaaacccaggcctgtaatcacctctgaaacaactactcctaagcaagcaaaccccatggctggtagaccccgtgggtattttggcatcaacactgctcccctcccctcccatcccagtcactgcagtttagaattgcatgccaatttccttttctggcagggcctggacggcatggaagccagggacagcatgggccaggtgcgcagcagcagcagcgcagcattcctggcactgcaacaaactgagaatgtgtctcaagtgactttccagtctggcccttagtgcccaataaccagagtgtcagaagtagtgagactgaagctgtgtttgccagacacccaagtccatagccagctcggtactcctccattcactctctctgtctcccctaatggggtaatagatctctttctaagaaggatgaagatggcgtttgtccttggccttgtaggtatggacggagaggagggtagaaaaggagttggtgttgcatgtttctaaagcatctgagaaggtattttgatattggcagaagaagctagtggcaatcccatatgtgggctctccaacactgactgaccccaaacatgctgagcccagatcaggctggccggccgaaaggtggactgtgtctatcatttctgctagattcctatgtgaggaggccagggatggtgctgaccttcatgaaagatagcaggctggagttcccatgataccagcaagatgaggcttgattataaaaagtgcgcctcaaggcagtgatacagaggagtctatgaagctggagtcttaggggagtggttgagtccttctgcagcggggatggggcaaaatggctgtgctcaggatcggctgaggcgtttggcgacatcagcgtaggccaactcgatctcactgtcagctgcacaggtgttggtgaactcatcacgggcataggcgttcttgaggtaccgccacaggcctgtcatctcagccgggatatcatagttgcggtatttcttggccacaatctaaaacagagatggcaggacagaggtggtgtgaaggcatgaaacaaatcattagaaagtgttagtggccgtcccagtgtgtgtgcactgcaggaaacctccgtgcatcaccacgggccatcagtgatatgtttgaaatgcaaggtggcagtgctgtcttctttttgttttgttttaatttaatttcttaagtaaacataatttgccctttgacctagtgtgtcaaattctaggaattttttctcaggaaataatcatggatggatataaagatttacctacacaattatgatcccagagctattttgaataacaaaaatggtgcacagcgccaaagtccaacaatatatgaatacatacattatcttacacaaataaaatgtcatagtggagggacattaaaaatgatgctgctaagaaaatctagtgatctggaaaactctccaagatagactattacatttaaagttcaagtataatgcatttggagaaacatgtatgatggctagatgtctatatacctatatattaccagtggttatgtctgattgatagaattaccaacaatttttcttttcttctttctcttattcactttgttttacacaggccagtttttcccttctttatttatagaagggaaaaaaaaccatgaaaagcaagttagatattggaatgtatatgtaggtttagactatgacataaaagtaagcaaatactgatttctgttctcgccctggtttgccacagtcaggggggatgtggactggagagttctggagaagtggtatttatgttgagagaaacaagagcaaagtgattaaaagcatgggctctggataccaactgactggatttgcaatcatggctccacttagcagctgtgtgacattgggcaggttacttaacctttctgagctccaatttctttatctctaaaatggatataataataaaacctactttggagtaataaattagttaatacacatcaaatgcttagaggagtgcctggcaaatagtaaatactcaataaacatcaagtattattataattcattgagacctagcttgtacccatttgcatgcattttcttaatggggacagcaggatggtttctttaatgaggtctctctagctgcggcagcttcatggacctgtgacctgtgcagtctcaccttgcactcagaagagccctgctgttgatttaatgctctggggtcaatgtgtggaaattcttaataatttttaaacagggcccccctgttttcactgtgcactagggcctgcacattagctggtcctcctctagcccttccaggctaggctagggtaggggtaacaggagagtagtatcacttctgactcccctccctccctcttttctgtccctttccttccctccctactcccttccttccttccttccttccatccttcctctctctttctctcactctctctctccttctcttccttccttccctcttttttttggggggatacaagggggtacatgtgcaggcttgttacctgggtataacgcatgatgctgaggtttggggtatgattggtcctgtcacctaaataatgagcatagtttttctacacttgccccctccatccctctgccaagtagtccccagtgtctattgttgccatctttatgtccgtgagtacctattgcttagctcctacttataagtgagaacatgtagtttcatgttttctgttcttgcattagtttgcttaggataatggcctccagctgcatccatgttgctaaaaaggacatgactttgtttctttacatggctatgtagtattccatgatgtatatgtaccatgttttgtttattcagtacactgttgatgggcacccaggttgatttcatgtctttgctattgtgaagagagctgtcataaatatatgaatgcatatgaaatttttttggtaaaacagtttattttcctttggatatataaccagtaatgggattgcttggtcaaatgatagttctgcttttagttctttgagaaatctccagagtgactgaactaatttacattcccattaacactgtataagtgttcccttttctccacagactaaccaacatctgttgctttttgactttttcacaatagccatcctgactggtgtgagggaggtgtctccttgtgcttttaatttgcgtttctctggtgactggtgatactgagctttttttttttttttttaatgtttgttggccacttattatgtctttttttgagaagtgtctgttcatgtcttttgcccactttttaatggtattatttgtttttttcttattcaattgtttaagttccttatagattctggatattagacctttgtcagatgcatagtttgcaaatacttcctcccattctgtgggctaactgttcactctgttgatagtttctatgtgcagaagctctttagtataattaagtcccacttgtcaatttttatttttgttgcaattgcttttgtaacttcatcataaattacttcccaaaactgatgtacagaatgtttcctggttttcttctaagattcttacaagttgaggtaaatctttaatccatattgagttactttttgtatatgatgaaaggtaggggtccaatttcattcttctgcatagggatagtcagctattccaaaaccatttattgaataggaagtcatttccccattgcttatttttgtcaattttgtggaagatcagatgaccgtaggtgtgtggctttatttctgggttctcttttctgttccattcatctatgtgtctgtttttgtacaagtaccatgttgttttggttactgtagccttatagtgcagtttgaagtcaggtaatgtgacacctccagctttgttctttttgcgtagggtggctttggctattccggctcatttttggttccacacgaatttttagaatagttttttctagttatgtgaaaaatgacattggtagattgataggaatggcattgaatctgcatattgctttggacagtatggccattttatcaatattatttcttccaatttatgagcatggaatgtttttccatttgtttgtgtcagctgcaatttccttaagtagtgttttatagctccccttgtagagattttaactccctggttagatgtagtcctagatattttattttattttatttttgcagctattataaattggagtatgttcttgatttggctctcaactttaatattgttagcatacagaaatgctactgatttttgtacattgactttttttttttttttgagatggagtttcgctcttgttgcccaggctggagtgcaatggtgcaatctctgctcactgcaacctctgcttcctggattcaagcgattctcctgcctcaacctcctgagtagctgggattacaggcatgcgccaccatgcccagctaattttgtgtttttagtagagacagagtttctccatgttggtcaggctggtctcgaactcccgacctcagtcgatccgcctgcctcagcctcccaaagtgctgggattacaggcatgagccactgtgcccggccacattgactttttatactgagactttactgaagttgtttatcagttccagaagccttctggtgaagtctttagggtttttgaggaatagaatcacatcaccagtaaagagagagaatgtgacttcttcttttcctatttgtatgccttttatttctttatcttgcctgattgctctggcaaggacttccactactacattgaataggagtggtgagagtgggcatccttgtcttgttgcagttttcaaggggaattatcccagtttttgcccattcagtaagatgttggctgcagatttgtcatagatagatggctcttattattttgaggggtgttcctttaatgcctaatttattgaaggtttttgtcatgaagggatgttgaattttatccaaaggttttctgtgtctattgagatgatcatttcatttttgtttttaattctgtttatgtggcgaataacatttattgatttgtgtatgttgaaccaaccatgcatcctaagaagaagcctatttgatcaatgtgaattaactatttgatgtgctgctggatttggtttgctagtattttgttgtgaattttttgtgtctatgttcatcagggatattggcttgaagttttcttttttcattgtgtctttgtcaggttttggtatcagggtggtgctagcttcatagaatgagttaggaaggagtccttccttgatattttggaatagtttaagtacgattggtactggttcttctttttatgtcaggtaaaattcagctgtgaatccacctagtctggggcttttactggttggtaggtttttttaaattactgattcaatttcataactcaattagtatgttcagggtttcaatttcttcccaattcaatcttggaatattgactttgtatactgaacctttactgaagttgttgatcagttccaggagccttttggtgaagtctgtagggttttcaagaaatagaatcataatcagtaaagagagaatttaacttcttcttttcctacttgtaggccttttatttctttctcttgcccaattgctctggacttccactatgatgttgaataggagcggtgagtgggcatccttgtcttgttacagttttcaaggcaattgaaaagtgtatttctaggaatttatccatttcctctagattttctagtttgtgtgcatagggatgttcataatagtctttaaggatcttctgtatttctgtgagctcaattgtaatgtcttctttgtcatttctgattgtgcttatttggattttcttttttgttgttgttgttgttaatctagctaatggtttatggatcttctttatcctttcaaaaaaccaacttttggtttcattgattctttgtatgaatttttgggtctcaatttcattcagttctgctctgattttagttatttcttttactatactagctttgaggttagtttgttcctgtttttctagttcctctaggtgtgatgttactttgtcaatttgagatctttctaactttttgaggtaggcatttcgtgctataaactttccttgtaatattgcttttgctacatcctagagattttggtatgttgtgtctttgttttcatttatttcaaagaatgtttttacttttgccgtaattttgttgtttacccaaaagtaattcaggagtgagttgtttaatttcatgtaattgtgtgattttgagacatcttcttggtgttgatttctatttttgttccactgtggtccaagagtatgattgatataatttctattttttttaatttattgagatttgctttatgactgagcatgtggttgatcttggagtatgttctgtgtgcagatgaaaggaatgtatattctatggtcaatgggtggagtattcagtagatgtctgttatgtccaattgtcaagtgttgaatttgagtccagaatatctttgttagttttctgcctcgaagatctgtctaacgttgttagtgagttgttgaagtcccccattattattgtgtgttgttgctaagtcttttcataggtctagaagtacttgttttgtgaacctgggtgctccagtgttgggtgtgtatatatttagaatggttaagtcttcttgttgtagtcacccctttactattatgtaatgcccttctttgttctttttttttttttcactattgttggtttgtggtatgttttacctgatatgagaatagtgacccctgctcttttttatgttccatttgtgtaatagatctttcttcagccctttactttgagcctatgggtgttgttacatatgagaggggtctcttgaagacagcagatgagtggctcttattttttatccaaattgccactctatgtctttcaagtggggcacttagatcatttacattcaaggttaatattgatatgtgaggttttgatcttttcgtgaagctgttagctggttactttgtagtttctattgtgtgcttgctttatagggtctgttggctatttacaagtgtgtttttgtggtagcaggtatcattcttttgtttccatgtttagagtcccttaaggatctcttgtaagtatggtctaatggtaataaattcccttagcacttgcttgtctggaaaagattttatttctcctttgtttacaaagcttagtttggtgggatatgaagctcttggttggaatttctttctttaagaatgctgaaaataggccctcaatctcttctggcttgcaatatttctgctgagaagtctgctgttagcctgatggggttccatttgtatgtgttctgacctttttctctagctgcctttaagacttttttctttggcattgaccttggacagtttggtgactatataccttggtgaagttcattttgtatggtatctcacaggtgttctctggatttcttgtatctgtatatccaccttctaccttgctttcattttcagagagggccctagaccattgaccctgggatcctcccattcagagaagccccagatcagtcactctgggcttttgtctccattttggtgctggtaatatgcagagtttcccagaaagttatgctgaagtgaaggatgatgatgacttgatggatgaaaaactcactgttgcagacatgttcacagacatctgggaacattttttcccctctatgctcctaggccagtgttgaacttctgttataacactgagctataatctattctgaatcatgattactgtttcagtaccctttttttttctaacttgtgggcagtgtaaggatagcaatcacaggttcttcacttctgtactccttgataatctcaataatgatgttgatcagaggaatgataataacaaacatttattcactgtgtgctctgttccagggactgctttaagtactttgcaaggtacttaaatctctaaataatcctataaggaagaatctattatattcccatttacagatgagaaaagcaagacaaagggagattaaataggttgggattcaaagtttacaatcttatctgtacatcagacaaggttctctagtgtcaagtgtaataaaataattttaaagactgaagatccctagcaatgagcaaactgaagctacaagagattatgtgacttaatgttacatgataaattaattaatttaaccaatatctattgagttaccattaatatttattacagtccttgctttataatccacagttctttctactttactactcagccctacatagctgataaagcaatgggtcggtctactcagaatccctcatgttccagccattaatttactgttgcttgtctccaaacctactcttctatttactattttttgtgatgctggggctaggactgagcagatcacatctcttctttgccagtgaatcctgttaggttctgccaagaggagttactggagagagccagcaaggttggaggaggagaagggagggagaagcccatgcttttcagcttcctctttctgtcagagtctccatttatttctgggagcagcagctgaatccagtttgctattttgtcaatactcacaggaccacttcatcatacccacgcagagaggccagcacatagcaggaactctgctttagaggctggatcccagccaacctgagcttggaccctggcaccagctgagcatcactttcaccgacattcagctctgcagggtccctcatctacagagcccctaagtttgtaagttttaataattccaacctcttccctttgttcctcctgccctaggagtagtagctgcctcttgaaggtagaacctcctagtatattttgcctttccagttctttactacatagtacttccttaaattctctctgttaaaataactggtttggtgtgggcaccaaagaagccacccccacactgttctgtctggcttaggtaactacaagcaagggtgatgaagtccgagtcctttgataaagctctcacaatgagagatgccaccacgatatctccccagtccctttctgttcactgaaagatgatgatcccttgggttgggccaagttcctttgagaagaggctgtcttggctaagagcaaattcatgcaggagtggtggcctgaccaagagaactggctggaatttatcagagtggatgaaaagggtctccaataagataaagggatccaaaagtatttttcacagtgacacactgattcatagagtagcctcaagtcatttcatactgaaattttattttcaggattttaaagggcagaatgttagtttcaatacagcagaaatgcaatttgtaaatatatacttctattgatgttggtgttccccttcttgtttgtctccagggctgaacatcgtcactatgctaggcaaggatcccagtgagcaaggaaaggcctgcagatgcctctcccaacgaagacctgtgcaccctgggccttggctgctgagctggtcatttcttcacacattggcttgactttgggagatgagaactaggagggggccagacaatgaatgttcaagccaaactctcatggagagcctgggccagagcaactctgcttccagggatggagataaacctgaaagcgagccacgcaagaggagagtgagcatgaaagcagcaagggggtaaggatgcacacggagatctgacgttcgcagggacttccatgctcatgttctgaatttgctctttcatatgaaaacagttagctcccacagcccagattaagttttggcatccgaagccaaactggaggcctgacttggcttccccttcgctctttgtgaactttagaggtttgccaggtttctgggatctgataagctggatcagcagaaatccaaagagataggggccaagggctggcctttgttctttcattggccatcttctttttgatctccagcttctctgggttaaccacccactgaattttctccaaggacagggcttcactgagtaatttaaggcaggtgggaattgaggaaatcacaggatgaagcccaaggcttgggagattcatttgtttgctttgttcaacaaatggtttttgagtggtagtgaatacatgtttgagcaagagaaaaggaaagaaggagggaaagaagaaaggaaaagaaggcaagaaggaatacaatccacttctgttcttctaggcatgagaaaaatgaattccaaaaagattaaatgatgtgcctcagctcatgctgctagttggcagcaaatacaggaccggaactcgggtctcctgatctttgcattgtatcactctgacacagtgtgactgagctggaattatatcatccctttcagtggtacttgttcctaaggagaagaagaataaaggatgatgggtggggcatgcagtagttaataacttcaaagagacatagattggctggacctacaagtgactattggcttggccccaaatccaaaatgttcttttctaaataggttgtatttgcccactccatttttatgcatgattccctctcagtcttcagctctaaggcatacggaaacaccagtgtacacacaactgagtgacttcagctcaagctggtacatgctctggttggagaggagatagcatttttgactcgggacttgagctgaaaaataataggcatatactcagctgacagatgattgaatctgagtcttctcagtgaagcatagaaataaactggatatcgtaaagacttacaccaggtgatcaaatgatcaatcaatgagtatttattgaatggccactgtgtgcccaccatcacactttaaaaagttcctttcctcacagagtttgctgtctggctgagacagtaagatataagcatgcgtaaaatagagcacagtatggctatctgatactaggctgacgagggtcaggaaagaatgggggaagaagtgctcattgacagagcttagggggatacaactactgtcttcaaatgaggtgaaggcaagcaaagctgttctctgttactctagagaaaaaatggatagcagggaggcatgcttgggctcattgtaaagaacaatgatttaataatcagagctatctaacatggtagggctggctcattaagcagagggctcctcgttctcagaggctgcagtcacagcttcacagaagcctgtcacagaaacagcagaaagtggtccaggttgaagtgggagattgttttggatgacctctaaatgtcctttccaactctcagattcccagggtttgttatataggagaggatgacactacatgctgcaaatggttagtaagtgcaatgatagcaagaaagtgacatcacttcttgcaacctccacctcttcatttgatagatgaggaaaataatgtgggctcaccttaggaagttgctggaggaagtgagaaggtgggtctgtgcacaaagaaaaaatgcatatgagggcacatttaatagagctgtaggggtgtagccagggaaatcctatgaggaagaggcctttggagtgatatgactgtatacaacaacgataattgcgactattacacatattaagcccccacaatatgccaagcactttcacgctgtatttactcttccaccaacacttgaagtaagcaatatatgcctattttataaatgaaaactgaagctcaaggaggccacacagccaacaagcagcagagggtgaccttgggtccttattacctgacttcagggtccaggttcttgaccaacaggtggtactgtccttgactcatccacacaggtgacctgggcctaagatggagctggatcttgcaggcccctgtgggtagagctctcttaccttgaccacatggagcttgggcaacagattgcagtcagccagggtcagctcatccccatccaggaacttgcgccgggaccccttgtcttccccacaagtgttggcgtcaatctcctctggtagaggggtgttcaggtagtcatccaatttctttagagccttggttaggcctctttcaagagctggcatgaaagagtaaaagggcctttattcaaacttcttgccagtggatacagtcatagggtcttcagagtggagtagctcatctagaatcctgtccccttcatcacactgccagctccccacacactgcagaatacctggaaaccattaacacaatgcagtagaagtgtactaaataggctgaaaaggcaaactctaaccaaacaataaacactagctaatcttttgctttgaaaaaaatacataaatatagaaacacagtctgggtgtggtggctcacacctgtaaccccagcactttgggaggccgaggcgggcagatcatgacgttaagagatcgaaaccaccctagccaatatggtgaaactccgtctctactaaaactacaaaaattagctgggcatggtggcacgcgcctgtagtcccagctactcgggaggctgaggcaagagaatcgcttgaacccaggaggcagaggttgcagtaagtgaaataatactagccaatttatttatttatttgtttgtttatttatttttgagacagagtctcactctgtcactaagctggagtgcagtggcgtgatctgggctcactgcaacctccgactccctggttcaaacgattttcctgcctcagcctctcgagtagctgggattacaggcacaagccaccacacccagctaatttttgtatttttagtagagacggagtttcaccatattggccaatatggtctcgatctcctgacctcatgatcggcccgccttggcctcccaaagtgctgggattacaggtgagagccaccatgcctggccaatactagccatttttttaaaaagttttggttatctataatttgctaatattccacatcaacctacatattacatttttaggaagaaaaggctattaaatgggtaaatataaactatatagaagttccaagacaaagatatgcatcagatattgtggaagtattaactatagctaacccaacccaagaagagttggggacaaggccttcagggggacttgacagggggaatagaacagccctttttgatgtcacccccagagaagtgatgggtaccagggaagaacacttgggttactctagggaagcttgttctaaaaatcactgctgtctcaaatggaagggctccaccacaaatgtgcaacccccagctgcacagaaagctgtcatgattatgactcaaggaatgaacacccaaaggaacataacatgggagaaggcttttacagtcttggtcaaataattatctgtcacataatttatttagacacaaaagcagacaaaatacccaaaagaacaactgtgggaagccatcatcactgaaaatcgttttgcccagaatctcgtagtcctttctaatcagagaacactaccatagaaactttctacttgagctcaaaggacaaacatggaggagatggctgaccagggcatcagtcactgcacctgtgtcatcagccccatccccagactctggtttagagcctgacactgagataatggaagtcgatcctgctgttcattccagtagatacaaggcggacactgccttctggaggcaaagccaagagggctgtactcttgttcagattttcccaagtgtgccttgttagccactcctctcataacccactttttgtcttttcatagaaggccttttgtttgagacaatggaaagacaccagcccaagataaatcaattgaacacttactggaatgtttgaaaactgcctggaggttgggcatagtttctcaatactttcttctccctggtgtggcatttgaactacttcatcatctgctttgtgtttccagtttgggagaacagagtaagcagggctgggaaaatgcagtatattccttaataattgtctagactgtgatgggattgcaaggctattcaaaggcaatggcagagggtgggtactaaacaatgcttattatgcttttctccctgaagcacttgtgatttatttgtttgcttgctcaatccctctacccctttcattcctggagattacagcaaaatcttgattataatgaagaaaggaagaatcaaatactgggcctgtcaaaatttgaccaactaatatcatctgagggaaagagtcatacgataggagatgagacattgcaggttctaatctcaaatggccctggagacctgagtgggctgttgcacaagtctgtgcccatgtcaccaggtctgggaaatatcatgaaatttggtgaaaagcctagagcagtgattgaagttccttgggaagatagttctttatatccctccggtaattcctcgagatggaaggcatcaagtctggtgacaggaatcattgttgattcatgttgcaactgtgacattccatggagctttccaagtcagcacattctggaaggcaccctctgtgtatcagtctcctcacttgggtttgtgtatttttgaccaggaatgtgagggctgcagttggtaacagccgtggtagaggaagaggagacaaggcaacagggaaaggactgcaaggcctgggactaaactgtgtttaaatctcaaggccgcccagggtgaattcactgggaagctgctgagccttaagcttcaaggtgtcttgctttcctgggtcccttccaagcgcttggatctgatttcaagaattctgtattggtacttattgtattgccttaaggcttcataaatcccacaaatgtcgttgatcctggcacttacatgtgaccttggacaagttcctctacttcactgagtttctgctttctcatctcaataacgggactaaggatccttcaccctgttaagaccactgctggggttaactcagataatgcagggaaagcacctaatacagtgcctggccaatacgaggacatcaattaatggtagttgttgctattgccttaccaaacgtggggtcctcctgttctctgttccttgccccatactcttggtcaatatattcctgaatatcccaaggtgcagtggagaatgggtgattttaagaagctccaaatttgtggccaactccctggagaggaaaatcaatagcctggagatttgcttcccttacttatttagtatacagccaaagccctgttccttatactcccttgggatgctccttggtgataagctgtgttgaaaggcacacccatagcaaaatagacacaacatgcctgtgtgctgaaacactaccatattatcggatagcaaatggcagtacccactatacgctctgccaattcttttcctcccacctgccaactcattcctctgaccctggctcaatctgccatccatagaatttaatgatctcttttgactgatggtacacaggtcatgaaactatttgaactttctgctctggtaggaacaagggggatgtgaaagaaactagagcaacaaaaagatgttaattctttgtgtttaattcctcgtaaatatttgatatcctcactccacataattactctgagtagttagatgggggtatccctccaactacagcaagtgagcctagggttggggcacccaagacgcaggatcactaacatcccagggacttgatagatacccagtgttttaactgctttcttcccctctccgcctctgctccccatacagatttattctgtaccacacacaaatgcactgggtaaaatatgtgatgaggaaacaaggggaatagttcataaatattctgagccatatgcaaacaatcttagatttatttttctcttttttaaggaggaaaaaaaatccacccattccatgatcacttccagattcattgaggttgatattacataagacccaatattgttttctcgtcgtagagaaataatgacttggaaacagcaatttgagctaagaaaataatatattcttaccagggcatggaggctgaatggggactggggagccaagactctaacccagcctccaacaagttcttgcaagaacagctcagccctggtttgctggcaaactcagtgcagcacaggtcctgatgagcataaggcaaagcagactcctggggctcaaaattcacatggagaggagcagatatcaaaggtggtctttgaaagaatgagaacagctctgtgggcccaggtggctgcacgctcaacttctcatatatggtttttctcttgtatgtgtgttgcagcaaaataaaaaccaggaacccacctgtgaccgttgtctgtagattggatgggtgtctgttcaactctccatggagaaggaggttgtggttattgggcactggcctgggccgagtaccctctgccctatcttgttccttttattgccctagtcccataccttagcaccagcaaggaaatacactcactgaattcccgcagtgagctagggatgtttatgcaactaccatttaaacacacaatgaggctattgagatggaaaatattattcatcgtcattcaacagatgaagaaactgagtcttagacttacccagggcacatacgcttatgcaagcacacacatagctggtccttaaaccattcaaactactcctgggacgtacaatggaaatgtgccttgctttgttttcaactgctatggtcttccttacaagctcctaacctctgggtggtggaaaaacaacaacaactttaatttcgtccattttggattataacctagtctgatgtaatcatctaaatagtccccctagagaattctgtctctttgcattgatatgctcagtttcccagagaacctgcccctccttgctctccttcctgagtcagtggcactgggaattggggactaggcccctgtgacctcacagcactggggagatggggtttctggaatctatgggtggaaggctttggaaagcgaatacaggttctgcatttcttctgtttgcttccttccagagtaaccatggggatgctgggtgggggttacaggtgggctgcttgcctccctccacaatctggaaggatacccaagcaaagcaccacacggagctcttaacatgctctagttccctgaccctcccccccaccacctctcctttcttcttcatccccaactcccctgtgctaggaagggtgggcttttcttttagttttcccaggtcaaatggcccaccaatcattgagcagaaagcctcgcggccttgctgcatagccagtacaactgtttctactctgtgagtcgaggcctccaggcagggtttttgatgggtaaaaattgagaaataaaagagtttagaacatcttagacaataggttgggtaaaagtctactgtcttgttgaaaatgctattttgaagatcaaaagctgaatattgaattcttttttctgtcttagagttccttttacagaaatcctaatctctctgaggtcaatgaatgcctagggcagattagaatcacgtactcagagtgacagagagaaaaaaatgttcaatcgattagctctattataatttaggtgcaaagcccaggatttaagcgcagggctattagattctaaaacataaactccttctactctgcaaggccacttctgggtgcaaggactgtcccatcactccttgggtattcacgtggcctgacaggtgctgcaaaatgttctcattcccctgacaaaagaggatggggttcccctcatgactcccccatgccttaccttccaactaatttggtaacatatttgtgttctgctaccagtgcttgatttcagatataattcttagtactttcagcgaccgtgatgaggtcaagaaggagttttctctgagtagaggggcaaccatgacccatcacatcacttttcaactctgcctgtactaggggccagtgctgtcacacgggctgtgtgacaatgaaacatctggtcaaaaagtgagaaatccatttggatttttcctaggaggaaagaaatatctagatattgagaaatacctggagcactgaatgaagtttttacttttcatcttctcatttgagatcatgttgatataaccaaagggtgcaaaaaaagtacagtggtggtttgagaaagaccatggcagacggagatgtctctggccatcacatatttttgaagagaaaatacaaagatggccacacttgttgacatttgatagtttaaaacgtgaatggtaacgtgatggaaacaaaaaataataataagaagaatatcaccacttactcatctgttggaagaagaagcctttctttccacaggcagctaggacaagaggaagagacactgagagagatcagatggactaggccaaagatccaggagcaagcgggatgtaggagccccagcagggcccaggaggattgggagggtgaggaaaagggcaggtgcaggccaagcaggcagaaatgtagatgctgctataacgagctcaattttgaggagaggcaaagatattctaaggggattttgaggatgttcagctctgtgatgggcagtgtaaccaatcccctcccccaccagaaaactttacataaagatctgcattcatctttcaggttttagaaatgagtcatgtagcttttttctcagttgccaaagtccttaaagaaagagaacagtagcccagttacagttaggttatatgagtatgaatgaccacacaaaggcaaaattataaagcaggtggaaactggggttttctcatccgcagtgacctttctaggactcatggcaggtaagggggggctgattttcaggtccctttgtcttttaaataatgtctacaccagattcttagaccacatgaagtcagaaatggcagcaaggttttagaagatgggaaggggactttctatcaggtctgatgggacgctctctgctgtgcctgggccctctggctatgtttgcatgtcactggtttcatcaaggaagaaacagagaatctgggtcgagtatgtcggggagccatggcttctgataacaaacacagtagcagagcagcacattcactctgccataagagatttgggtttgaatcctcagttatgcttgttcacaggttcacatcatctagtgtctggtgcagagtgagacttgattaaagttaactgctattattattattacagctatagaacttgggtttatgagaggatgaaggggaagaagacaccgagagaaagatgagagaagagatagctcaaggcagaaattcagtgtctgaagtgaagtttatctgaacatcctagcatgttccaggtccaaggagaatcctggagagcttgcaggatgaagcttgctcttgactttcctaacatgttagggatctaaagttgcctggaagcatctctttgggtttggctttgctctctccaggccacatgggtgtgtcacattttcttagtttgacagtttagagagttcatgtccacctttggcactgaaccaagaacactggacttggcctcatagccagagaggaggatgttgtcaaattggccctgggtgtgaacaacccaggggctcacatgggggaggcaattcccaggcctccgtttctaggcactgctaaaaacaggaaaggcagaaagacaaacagcggtttatgagaaagcaaaatgcaatggcaacttcaacagattccccactgttccctcgtgtggcgtcagctgggctacagagagtgtgcagcacgtggtgccatgggtattatttgtttgttctagaaagaatttcagcctcagaggggaggatgaattaaatgacaagctcctatagttctttccagtaagaagccagtaaatgattctttatttgaaagatagcgtttaagtcttacaattatggtgggttgggatataggacactgttggttgcccaccctcctctgtggtggggagaatggggtgttttctgatgtatttccaaggaattcagaaactttcttaaggaagacacagattctccacatagctgcttccccaagctctataggggattcttataaagaagcatctttttatttaatacagctccacaaatcacccttatatttggcgtatgttcagaagtattagtacaacaacaaaatgcatattttttttaaaggcaagagactttggccagtatttggctatgtttaaaacaccagcatggtaaacatttaggacaactttagcatgcctttagtataatattttcttaaagtatgaagggaggtagggactccagatccaaataattttctaaacctcttaaaagccacagtagatttgaagagaaagattatcacttaggtcttcgaattaagtttccttttgtgtactcatctgtagcatgtaagctgcctgaatgtttatttatcaacaggagaagggaggaagagagagagagagaaagagagagagatagagagagagagagagagagagactgactgaatgtgggaggaagctgcagagctagcgagctcaggagtgatcaggggagaagttctggttagggaacccggcccagactttagccatggggcagtggcgacaccttctggcttatccctgagcaaacaaacaaacaaacaaaaaactccccaaaaacctattgtgtattttccacagagaacatgtacgtgtgttttctattagactttccagaaactcataaatgattgtagaacccatcgtgctaatagaaagtacggcataaatgctgacggaagctattaatgctgattgtagtttatgtggccaaatgaatcaggctgaaatctgtgagtttttttatggttactttataacaggttatttttaagtatcaggccatagattaggtttaatgcggatgctcacacacttagaatgagctggttaagagagattctaactttatcagtcatccgttccagcgtttagacctagagatttttctcaattctccctcccccaaaacacttaggctgaagtacattcaccacattttgtcttgtttcatcctcaaatagccacatcttttacataagagccattcacaaacttaaaaactgcctctgtgccactgcaatgctagactgaaataattactggatttggtgattctgtgaatatcctacaaattctcttccagttgcccattcttttatttgttaaacaggcatctattcggtgcccactgtgggccaactttgtgcccctttccccacatggattgctgggtgaggaccctgatggggaaggtgggaagtgttgagtatatttaaggaaatacacatggtagtcattcattgagtattcatcggatcgtgaactgatttgatcaccatttcctaaatgacacactcttgtttaattcagcactacatacatattaaatagtggattatattaaatgttaatatacgcaagtcaagagcacagatcatgggaccagctgcctgggctggggtcctgaccctgacacatactagcttgggcaggttgcttaaccggtgcttgtttccttctctgcaaagtggagatcataacatggcataccttagagggttgctgggagcaataattgagtcatcacctgcagagggcttagtacagtgcccggcatgctgtaagcagttgttatgtacaatgtgtatgtgcaacgcatgatgatgctgatgtatgagaaacaaagcatacaaaaaaagcaacaaaaaattcttagagctgcaagaaaaaagtggctcttgcctctggctctgctcagtaaacatcgtgcttgactcatcctctgccctgaaatgctgacatgaacagggatattcagctgttcctttcattctgactctacagccagaaccacagtcccccagccgaaagccttcatcataacagatgtgaaatggggcaaccttaaaggttgggggtgactgatacttacacagaattccccagatatgctacaagtacacctggacctccctcccccttgctcagagcagttccctggataccctaatgtgccccagcaaaaattacagtttgtggggagaagctacccattggatgtttgagttgcacagcttttactacatgagtcttgcatctcctaaagtttgaagtgtgtagcaaattaaatgtgcaattttatacttctgtttcctgaaatctagtagggggtaaatgactcagatttttccagcaccaaaggagaatttaaaatagtgtgtcctttttggcaatggctaggacaggtattttcaccagagagagaaaaaatatcaccttaacttgaaagtgaatatataagaattgaatatacaagaattcagtctccttttatttgttactagtagaagacagagcccatatatatatatattttcagggtagcaatgtgccctatcaaaaatactcatcttcctagattcccagaatttcagctacagaaggccaaataaccaagttctggctaaagagatatcggtagaaattaatcaatgggcttctgggaaagataagatagatgcggctggcattgtctggaatgcggatgtgatgtttgggggtggagcaaccatcctgtgaaacaagaatgaaagtcacacacgaaagatggagaattaggagctctaagcagcagctcaattctcgacttctttcagcaactacatttgcctggaactctctactctctggacttcttgtcatgtgagaaaagcaaattcctcttaagaagtaaacatttatcaagagtgcttagaacagggcatggttcatagtaaaatgctatataggttttgctaataaaatacatgtttgctttagccactgtagtcaggcttctattacaaacagccaaacacaacatttgccaatatacataggtattgccaacatgccaacatgtcattattccgctttttttttttttttttgagatagagtctcgctctgtcacccaggctggaatgcaatggtgcgatctcagctcactgcaaactccatctccctggctcaagcaattcttctgcctcagcctcccaagtagctgggactacaggcgcgtgccaccacgcctggctaatttttgtatttttagtagagactgggtttcaccatattggccaggctggtcttgaactcctgacctcgtgatccgcctgccctggcctcccaaagtgctgagattacaggcatgagccgtcgcgctcagcctcattatttcacttttattctagcaccttgcacagcgtatggtactgaataagtatttgttgaaagaataagccgttcagtggggtttgaggaaagatgaaggaccctaaaatcatgtgactctatttatatacttatgtaataagctttaactctgtagaggaacaacagttccctttctttgtataatagtagcccttggtcttttgaggatagatgaagggattcaattagtttggcctgagataccctcccacagagtcccagccactttgttatcagagccaagagagaagcataggttagcatcaacctctctgccaaacgactcaggtaggactgaggcagtttcagacctgggcaaaatgttgagtaaaactcatcttagggtccccacaatggaaacagaacatggataactatcattgcaaacatcagtgggcatgagaccatcagagttagagctgagtgcaggaggtctgagaaatcacgtggctcaaccctcccctccccagaatgttctggaagggaagaggttctagacactagcacagagaaacatatatacacacacacacatacacacacacacacacatatatacatacatatacatatatatatatatattttattttttttattttttttgaaatggagtctcgctctgtcacccaggctggagtgcagtggtgtgatctcggctcactgcaagctccacctcctgggttcatggcattctcctgcctcagcctcccgagtagctgggactacaggcacccgccaccacacccggctaaattttttttttttttgtatttttagtagagatggggtttcaccatattggccaggctggtcttgaactcctgaccttgtgatccgcccccctcggcttcccaaagtgctgggattataggcatgagccaccgcgcccggccagagaaacgtattttatttaccttgatccagatcattaaatgctttgtccaccaggggtcttagaaaaataatttgacctctggctgctagctgaaaaaagtctagaatttagccttctgtgttttctcttttgactcttggtgaagtatcacttttaacaccaaatagaatttcccttgaatgtggttataaaaataatggtgaaaagaaaaatcccacttcagcgaagcccgccagcacactggccatcctagtgaggagagctgctcaggttcttgcattcttttattgattggttctaagtgagattattcaccatgaagcttgatatcatataacagaggctacaaaagcattgtatgttctcacgtcaaagacaatgctagtcacagaacatcataggatttaaatggggactgggaagttttaaataaatacagtcagagcataggggagtctgcaacatggggacagatttaaaaggtgaggttccacagcggggacaggaagtggctggaggacgtgcccgtggctctgatgaggccccgtcatcatctcccaagcaaaggcatagacaaggtagaggtgtgttgaagtgtttgtatacttttttttctctcatttaacaaatattgatggaccatctgccctgggtcagatgctgagctggggtctggggtgacaatgatgaaggaggcacacccagcatgcttcctcacagagacagctgctcagaaccctgtttctcacagcacagccctggaccaacagtgtccgaatcgcctgggagctctcaggccttgccccagatccactacctcaatatctgcttcgtaacaagaccctgtgggaaaccaggatatgccacccccaaaataggaaggattgttgagatgaagacaattcagaagaaacagaggcagtaaagctctctgccctccctctatttgtctaaaagcaggacgtagatttacaaagacaaaacgtatcttgcctccccccttctaccagggagaaccactgaaaacaacttaagacgcttatgctcctggagatggccctgcaggaatctacattgaacaagctttgctaactggcctttatctgccattcatttgctatcccccgaagttgctgcccctagagactcaaagtgttttttcccttgtcacatctctaaaagtttactgtcctttgatgaggatgctgtgaaactagaattcaaagccatctctttgagaactcctcattatagaaaatatacatgttaataaacttctgcttgtttttctcttgttaatctgtcttttgttacaggggtcccttccaactaagaacctatgggggttattcttcctctaaaacccccacgggattcaaatgtattcgcaaggtagaaaatggtctggctaacaagaggaatgaaaagaagtgctgctttatgcttaagccttaagtctgtgcctgtcttaactcatgaggctactccggctcagcctggaaacaagcttgagatggggtggagtgccttcctgcaagacggcgctggagcaggatttgaaagaaagcctggggttttaaagccaaagttccatgtagcaactttttcccaacaaattaccctctctaaactgctgataaagtcagaataccagactagatttaatccctggttttagttcttatgtctttgcaacactagttggtagcaaaagatgtttaaaagctgagaaatgctgaagcttttgctagaaggttcagtgcaccacctggatttcacatcttgtcattttcagccccagctctaccaaaaatgagggaatctgttctacaggttaacttatccagagatattctcccctaaaggtcagcagaaacttggaaaaagtttcctcaaagctacgtcctaaccacagacaaggggttatgaatgtagtaattgtataaaccaactgtgatactttcaacctacacacacacaatgaaatgtagacacacacacccatggacacactattgtacttctgtggtctgcatatcctgtgcttagtgggatattgtgtcccatcatgaatatattgtgtcccatcatgaatataattttgcatgtaagcactttcttttagattaattgaaatgagcctgtctaaggaggtatgtgatggcctttgccagtacataagaacatcagaacacacacgaagtgcataagtgtgtgtgtgtgtgtgtgtgtgtgtgtagagagagagagattgagaaacgtatttggttcctatgtgtagactgcacaaagacaagaggtgttggttgcataggatgaggtaacggtaggaagaggtgaaagaacatttaactcatgtgcaaatcagttatttaacgttcctttattccccaggtcttgatctgcatccaggccaggccaggagaactcattctggtcagacagcgggaaattccaccacatggaatggtgttggtggtctccgctctactccagtccaggagcccacacagcaaaattccactaatgaatgcgcccacccacgcagggcccagctctccccacccccttctccccatgcctgccccattcaacaggccacgccaccaccaaccgccttccttacaactgcccaaggattcgtttcaggagcaagatttgttaaattataaattggaagcatccacctcaataatgaaccaaatcaaagaccctctggaggaatccctcaggcagctcatgggagggaccagaggaagcatttgcccactcctctccctcctgccctcagccccaaggaccctccatgagggaggagacgaggacatgcaagtgcagagcccaccagacctccgaggtgggtcccaccgagcctaggttatttgtttttccttacaagaatgctagtcaaagcaaaactttaacccaacaaaccaacaaacaaaatacccctagttggctatttgcacacaggggttgccaaggaaggcagcctgaagggtccctttgtgaccagaggcgtttttgaaaggagacagcaatggctgctttatgaggaagtggtgagacggtcacatgttatccgcattgctgtggaggtcggcctgaccacccaggagccttcaccaagatggcctgataacagcccaccgtggggctcccaggcctctgcagcggtcttcctgggacccaactgtcctccaaaagaactgcttccaacagagtagacatggagccccacggccacctaagtgactctgtttctgagcatgctacagggtaattaggtttcacattcctgctgctttttacacacggccttagctttctcatcaggcctgtggcagagcacaaggcagaatgagaaggggggtgccgcatccatcccctggatggccaggccctccagacagggccactgtgacacgggggctgggggctgggagggaggaaggggagaaggcatgaagcgccttatgattgaagtggcttggaataataaatatacacactcttttttaaacgtggctcaccacatcctgggaatctggaaaaaatgccccacttcactgtccctcaccctcctccccacctaccccccagcagcagtggctttcatgacgcctgggggaaagcacagggcctttgataataaggggcttgttagttctaggctaacagccctcccaggccgctctgaatcctttcaagcacttttttattttaggtcaaggaagttcgtaaatgtaaagactcgagattgtagaaggagaagaggaaagggagaaagaagcatttgggggtagttgtcattgggaggggcagccagggacctcctatggtagatccgtcaggcctggtggacatgcccttcccttggtgtgggggacagataatggaaggtggctttgagccttgaagaagacctagccttgtttgaaccgtctaagctttggcttagataaaactgaatctttgtataggaagaccctttcgaatccacaggccttgaataaatcacatcagctggctctggcgacgattcctctgcctgccagaagagggcagcacatgcttcctcattacagggaaagctgggctgcccagtccaaagggtggacactaggtatggaggcggggggagcactgtgaaattaatagcagcagcagcaacagcagcagcaatagctatcacatattggtgcctactgtgtgccaggaactgtcctaagtgatttatatgcattaattcatctaattaacatgacaaatcttcaagagagggtgctattacaatctccatattaccgttgaggaggctgaggcatactgaaattaacagaacttgctattgtagccacggactgcctaagattgaggtcagcaaattacagtccaaggactaaatccagttcactgcctactttcatgctgccctcaagctaagtattgttttgtgttttacatttttgcatggttggaaaaaagtcaaaagaagaataatatttcatgaagtgagaatgatgtgaaattcaaatttcagtgtccacgaatgatgttttattggaacacagccctatttatttgtttacatattatctgtggctgctttatgattcctgcagcagaattgagcagagtctggtagaggctatgtagcttgcaaagcctaaactatttactatctgaccctatatagagaaagtttgccaagccctgacttatgaggaagagctacctgtttccaggcaagagggacagagaacagagttgctatttactggaaatggagctagtatcgctatcccagggcaatttagaagcaatgttgaacttgattcactttttttccaacagggcagctcaaggtcaagcaaaaggagggtctgacatgtcactgaatagcctcaaggaagtaataaaaggttagatctggaaaggactgtgaaagtccactattatgtctcaagtctaaggtgcacatttttttcactctttaacatctgtgaaatcaggcaatgtcttacaatcaaaatatgagaggttaagtgaaaacactttgtttaagtgatagcattttgttgttgtttcttagaggtttgtttgtttgtttgtttttgagatggaatcttgctctgtcacccaggctaaagtgcagtggcatgatcttggctcactgcgacctctgcctcccgggtttaagtggttctcctgcctcagcctcccaactagctggaattacaggtgtgcgccaccatgctcggctaatttttttgtagttttagtagagactgggttttgccatttggccaggctgatctcaaactcctgacctcaagtgatctgcccacctcggcctcccaaagtgctgggattataggtgtgtgccactgtgcccagccagtatttaaaataatagtgtcgtacaatcaatgacaccttagattaggcagttcctgcctccaaagatccagcctctttttggtcctttctgttgatgggatactcacttcttttgctggcagtccattctacagatttaattttaaagtttcttttcttttttctttttagacggagtctcattctgtcgccaggctggagtgcagtggcaccatctcggttcactgcaacctacaactccctggttcaagtaattctcctgcctcaacctctcaagtagatgggatataggcacatgcccccacgaccagctaatttttgtatttttagtagagacggggtttcaccatgttggccaggacggtctcaaactcgtgacctcgtgatcggcctgccttggcctcccaaagtgctgggattacaggcgtgagccaccatgcccggcctaattgtaaactttctaatgttgagctgaagtgtgtaagcctaaattttctatacatcaaatgaggatgatcttgcttaatacgtttactttaagagtcttaagatcttattaaaagggagcgaagggaaggaagcactgtgacccccggggtagggaggaccagagccggctgcaggaatcagtctgtcggtgtggtcacaccaggcagtctgcaagatgggaggacagggatgagttgttggggacacaaaccatgaaaacctggaaggaaaagaaagaccgccagtgatacagatgagttctttttctagcagcatcagccaggagcatgacccactgcaggtggcacctcttagaaggagaagacaggagcaatttgaagattcgggcctgaatggaacaagaagacaaggaaagagcgaggaatgcacctgtggctggcttgcccctgctgccttatatgagggctctaggagatgaggaagggaaatgagagaggcaggatgacagtcattgatattgtgttaataagaaccacaatgtcctccttcaatcacgttcccattcagtgggaatgatcatccaaattctgagataaactcactgaggttcctagaataacccgagagtcttcttccattctatgtggcagggacaatcaatttttccagaataagcccagggagcttccaggttccagaaagaggagcctctgatgtgagccttagggaggtggaaaccttggcctttatttggaaacagaaccaagactgctcagggacctgtgtggctaatggccacttttttgttccagcaacaaattgggaaccaggaggtggtgggaactagggtacactccctcgccctctggtaaccacgtttgagcttggattggagagaaaggagaagcagagggcttagccctaaccaggtgcttttcatctggggacatgtgtcctggatttcctgggacagtaccaatttcttataatttgattattttcaatgaaggcaatttgttaggcatctgattttcagtttggaaaacatggccactgcagttacaactgatgaagggcaatgcaatctgagcacatgcccagcacgtcacagataccaaggaaggtttttagggctttctttcggaagttagaagcaccttattaggacaagtattttaggaagagtatgttaggacatctcagagtcttccataaaaagagaactaggtgcagccttgcgagtgaaaggggtacatctttgcacatctagtgcaggagcccattcatcttgatgaaaatagataagcccagacaggctgttctgtgtcccatgtgctgggtggacagagaggggcagggaggttggcgacacacgcctgaggctgcagggaggtctcctgagtcttccagagaagatggagagaaaggaagaaagtgagtttcaggtgaagagagaacacagggattgtgagatcgggaggagcacagctcacaggtgggggaagatggagaggagtcagagcagcaggaagtcagcagggcctggagtctacagcagcctgaaagagaagtcacaggaggggagagccaaagaaaatggaaaccacagctcctccgtgcctgcggctcacagcaggaatatttgttattcttctgggaggctggtttgtttttatcttctaggaggaccgagctgcagctgaccaggggccctgttttgctttgtctgctcacaagtttagagccaaatttgtggtctaccttctgtgtggcgcacgaaggccccggggctgccctgactgttttagctcacccagggctccatttgatggttgtctccttgtttttctttctcacctcctcttggcctttgttggtttgccgtgctttatgcatccctgggagtagctataaagcctttctggaacaagtggagtataaattttaaaatagaaagaaggccccccaagacagaggaatacagaggtggaaataagagagaaaagtggacttgaagggggaagaaaagagggaattcaaaggaagccttgaaagactaaaaccatccagattgggcaaaacaccacttagtgcaggtcgcctgggaggcctgagagagcttaagccccaagactgcatgtgatacagatgagatactattgcccctggggcttttcagacctctcactaggggaaagggagtcctgtggaagtgggctgcgcaaaaggaggttggatggaaggtggtcagcgtgaatagagcaggagaaatactgaatttttgtcttaggctacaggcataggcatgcctacttcctctccagctaaaaagaaaaggggcaaaagcacatgagaatatgacactggcaccaaaaacaaggatggtaattcttggtaggacattaactgtatctgagggaaacatgatagacctggaagaaattttaaaaaggggtaggagacttttcaaattagttaatcaaaatagagcattcaagatgcacattagatccatttgttaattacctgccatatgcgatggggacagaacatgaaataaatcatgtgtattgctaggattgaagcataaggaaagagagattgtggaaaataaagtgaaatatagcactttctgcctagattatgataagtaactaaaatgaatttcttgaaaaccaagagatttgcagggatttttagagtctgttcaaatggcagattgagggtaagaaatgcaaaatgtaagacagatattcagagggagaagtccacatcctcttaggaatgacagagagtgggggacatgttaaagtaggtgtcaaagaaacccctttagggaagagacaaacccaaggagccaaaggggtgttccagtggcaggcggggaggggtgtttcacagcgacgcttgctagaggtggaggcactggcttgcagaaggtggaggcctgggcccttgctgaactccaccatgtgccaggcaggctgggtagagagcatgattaagggggaggacagacctaactgcttgctaattacagggatgctgcaggatgtgccaaaggggcatggatgacactgtgccctccctcaagccttctacttcagcactctatgaacctccaggtctaaacccagggcataacttctccctgcaagattgaaaaagtgaatgtggggctcagaggaggaacccctccagccaaatctaaatgcagtgctgctttctcccatctcaaagatgctctttcgcaggaccacgagcactcttcccatgtgggttcctgatccagttccctatcatcacccactggtcctcccctttctaagggagcagggtttgtgcttcctccatcagactgagctctctctggttgtgtagaatctgagtaatgggtggattccacatgagaaaagcagacagaaaaggatatccaagaacactttcagggagctgcacatagcaggcaaaagtctcccaggaccttctctgcagcattttataacacagatcactcttttaaaacaacaacaacaacaataaagcttgctttcccatctttatgccctccccactacccccgatttcctccatcctccctggctagtccttctttctcttcctccttgactcctctccctctgtcatcccatctatgtgattgatccttgggcatcgtcttaatcatctaaagatgtataacccctcaaactgcatttttataccagaactctctgctaaggtacaattgtctacccgagataactgctcagaacaacggctgactttttttttttttttttttttttttgagatggagtttcactcttgttgcccatgctggagtgcaatgacgtgatctcggctcactgcaacctccgcctcccgggttcaagtgattctcctgcctcggcctcctgagtagctgggattacaggtgcttgtcaccataccctgctaatttttgtatttttagtagagatggggttttgtcatgttggtcaggctggtctcgaactcccaacctccggtcatctgcctgccttggcctcccaaagtgctgggattacaggggtcagacaccatgcctggccccagcagctgactttgaacgtggtagtgggcattattccaagcacacttatgaggtatacacagttattacccccatttcacagatgaggaaactgaggcattacagagttgaagtaacctgtgccatgttacaaggacaagaggcaaagctggtgtctgaactctgaactctaaagtagttggctttagagtctgcaagttgagccatacacagtcacctgcctctctgcataggaaacacagcatgtttagaaacaccgtccttatccttctccccaaaaccaggcgtgtgggtgagagatcttagagcacaagaaaacgaagcaacttccccaagtagcacctgacttaatgtgggatcttgccaccgagtcatgagaaaatccagtctacatttaagtgaagtgaagagcaggttggaaagagtgagaggagggggcatggaggcagtatctggttactgcagaccaaggggacctggatctagaaattacagaggaggggtgagtacagtgataggcctaaacacggagcacagaatcgtccctcagggaacaaaaaaaaatgcaaggctgctgaggtatgagagttgggccaggccactgacgctccttgatgacactttggagaggaggaccatgcaccaacaaagtttaaaaagtagaaaatagactgaatgggtgggagatttggaagagctaactgagggggaagcaagagctgaagcagcagtttctgatgtcattattcatcttagtcccatttttgtgctaatagcaataatcagaataatcaaatttaacagttacgaggccagacactgcgctaagggttttacatgcgctgagttataaaatagatgaacctgcattacaaaccttggtgatattattaattaccttattgccagataaagaaactgaatgtaaagtccattttacagatgcagagccagaggctcagaaagaataagcctcttgggtaaagttgtgcagctagaagtgctgggattcaaacccaggccgggaattgcacatgtacttgttttacagctccctgtagattgttagttcatggagggcaatgactttgtctcgttgccttggcaactccagaacctagcacagtacctggcacataagcagtgccctttaaatattagctcggacttgtagtcactttatataacttgtggttttttgaatgaatcagtgaatgactgaatgtacaaactaatggatgattctctccattactccagtactgctgggatggctcccacggatggggtctcggttgtggtagctggggacttacaaggctttggggaacaacagggaaattttacttggtggttcctgtagccaccacaggagtggagtggagaggtgacccaccatggagaaccatgtaacagtgttggcttttctcatgctttcattttgagagggcagaaaaggatcatgacctgggccagtgtgtgtatgggggctggggcattagtgaccaggtagaggggagggagggctctgctcaagagaaagtaaatgaaaatacaagagaaaccctctaaagaaagaaagttggagaactaggtgcagagctgaagatccagagggaaaaaaatggcaaagtaatgtagggcggcatgtggaaggaggcctgggcctgaatgctgatgctcttggggagaggccacagccatggagctcacacagagcagaaaggggatggaccatctcccgggtcaggggctgtggggctctgggaccgtaacacaggagccatgctgctctctacaggagggcaagccttacaggagccttcacctctggcttgctaagcctaagaattttggacccagttgaccacaactcgggggtattgggtgggaggaaggacaagtaaagaggaagggaggggtgtgggcaagttatagttccagggaaggaatgtgtggtgtcttgttaaacagaaggtggaatagcacatctggggacaggctctttgggaaagcagcaatgttggagctttgaaatgtgcaaatgagttaggggaagcaggagtcacaagggcaagtctcattacagaagaaaacagggtgaaacagaagaaggggaaacaatgaaaattggagagtactgagtttataagaaatggatatgcggcatttggtggaaactggctttggacttgggaataggagaactgtaaatatggataatatgtaaacaccatttataattttaaaaatctggagggctcaaatgagataatctttctgagggcactttgacaagtatgaaagaagatatttgtggctaagaggaaaggatactgggtgtggagtctgaaaacgagggttcgagagccagctctgccttgggggtagacaagtcatgggtcttctcgtttggttctctgtcctcagccgggaaagcagcaatgactcttctttcccacaatggctctgaggggccatattcatttcctaggactgttacaacaaagtaccacaagctgggtggcttaacacaacagagacttttccccttacagttccaatatcaaggtattagtaggtgtccttccttgcctcttccagcttccggaaagctaagagttccctggcttgtgacagcatcaccccagtctctgactgtcttcacatggccttctctcctctacatgtctgtgtcctctcctctcctcttttttttttttttttttttttgagttggagtgtcgctctgttgcccaggcaacagtgtgatctcggctcattgcaaccttcgcctcctgggttcaagtcattctcctgcctcagcctcccaagaagctgggactacaggcatgtgccatcacatctggctaatttttgtatttttagtggagacgggggtctcagactcctgacctcaggtgatccacccaccttggcctcctacagtgctgggatgtagtcaagagccaccacacctggcccctctcctattcttataagaacaacagtcattggatttagggactacactaaatgcaagatgatctcatcgccaaatccttaactaattacagctgcaaagaccctatttccaaatgaggtcacgttctgagatcccaggtggacatacatttaaaaaaatttttttagagacaggaccttgctctttcacccaggttggagtacagtggcataatcatagctcactgcagcttcgacctcccaggttcaagcaatcctcttgtcatggcttcctgaatagctgggactacaggcatacatcaccttgctcagctaattaaaaacaagttttttttttttttgtaaagacagggtcttactatgttgcccaggctagacatgaattctggggggacactactcaacacactatagggttcaagcagcaatgaagcaagagcaccaagtagattgaaagtactttccacatgcttcttcttatttcccagaagccactctctttctagtttcttgacacacacctctaatggatgtcattgcccacaagataaaaacccaagccctccaagctggcactgtgggcttcagtcactttttccagtctctgtccctgactttttctcaacttccccgcatcttctgctcaatgatctcagccaactgcttccttcttaatctttatgacccagttgaaactcccagaaaaggagtctcatgcatttacccccatggtaaatgcttctggttctgaataccttcgacagaaattattttgttcttttacctgcagttaatcagctctccagaccctcttggatcaaactgacttgaagcctgtccttctgcatctgccaggcattgaagactgaggaagtgtttgtttcttctttggacctccagaaccaagttttgcacttgtcacaatctgggtcctgagtagcttcctgaattatttacttcccgatacaccaactctgttcctgccatgatttcgtctcttttaccatgcatagctgcatatgctggtcgccttgatccaaagagatgctattctccttggagcttctggggcatctagcatctattcccttgttttggtccattgtgcatcagtcacttgttcattcacaaagattcatggagcacttaagttgcttggctttgtgctggactccagtcatccagcctgtgaggctgtcctgtcatcccattctgagggcaagggaatggctgccattgcccataggataaaaatccaagccccccaggttggcactgcagtggctagcctgttcctcctgggcctaacaccgttcttcaagtgttatacctgcttaattggacggttccattcaaatggctttaggtaattcttaaagggcaatgccaaatgaaggactgaaagtgctgtgagcataactgggggggactcagctccctttcagaaggccccgcaagagaaccaagtcctgaattctgtagccaatgtcagaaatgaagggcctgatgtaggatgggccaggctttgaggagtggctttccagggcccactgtcctgcagaaggggagaacacagcccaggtctgccttccacatttgccacagtagtgactgtgctgcctctcccttggcctctggaaaaatccctggagaaaccttgtagggaccagaaggaagcgggaatatgttgctctaatgtgatcacaggcagggttgggaacttgggacaaatgggcagtgaggaccgttccgtgcagtgcactatgctgtgcaataaggcaggctcagatgacaaagagcatccctctctccagcttggcagtaaagccccaagcctttcctcctgcaccagctaggcagcagcatccaccacctcctcccctgtgtcaagggggacaagatggtggtggcggggggtgggggcaaataataagcagtattggttccagatgcttctctggcccaagtatttgacatgcctatgggcaaattgaagatgccttgggcagcagatagaccactgccaagggttcttggtggaagggagtcactcaccagcattgttctgctgcttggtatttttgatgtaggcagaaaacttggaaaagatgtcgatgcccgctgtgttggattcccggtgttttgcagccagtttggggtacctggaatggaggatgcagtgttctgtgaatcagtagacttggagctcctttaagggtgagcctatccctatcatgataagcaatacttccctttccagctgcatctacaaaatgttttgggggtctttatcctcatactatagggagggtgggcattctcagccctagggcatccatagaagaaaccagaggccagtgaggtgctgagatctgcctagggtgacacagtctgctaggcaaagaaccagaatgccattcaggggtctcaggatgtgtccttttcttgggaccaccaataaggatgtgccagtgggatggcgcaatcaaagttccctctgagcttgcctctctatctggtagggttctcaacacttcccttacccgctaaaataaccatctactgccagtcctgtgattataatcctagctacacagagctaattctgggagcaaggagaagccaggtatgttagcattaaaccatttctccaaaggaagaatacccacggtcctcttctgaaatgcccttacatgcttattatttgtgtgcagtaataacatgcagaaactaccaagctccaaaaaaggacatgtgttttcaattgttttattttattttatttggagatacatttgcaatgatccagcccccctctctctctctttcgtagagtctttcattttgaagccacaataatacaagaggcaggctggagttagaacgattggccttgagactgaaggaggtaaacttgctcatgtgggaacccagggcttggactcattagccccatcaaaatgaaaaaaatcaactcaaataaatattatttcataagcattttatgggtatggccaggtagtggtgggaagagatgggagacagtcgccaggctatcattattttcaatgaatgtgcacctctgtgatctctgggtgaatcgtttttgactgtgggctggtgggttgccttacgtttaaaaagcaaaatcctttttgtttgttttgatgtttttgatagttcgaaccaaacaagactttaaaaaatatttgttgttctttaatgcttttttgttactcaactggcccatgagctaggattccttttggggccccttttggggccatgttaggtggctgtgtaatttcagagatactgccattggaagagtccagctctctgctgtgaggcagataaggaaggcattattgtcctccttttacatggaagggaactggatacctgagaagataaatgttgatggctaataaatggtggagggacgatgagaacctggtttcctggccctacagcagtgtccttccccctccactgcttctctggaaacagtgaaaggtaatttgcattgagcacctactgtgcagcaggcaggcactgttctattccctttacacgtattcaccatttactcctcagaacaactctattggtactattattagcctaatttcctacatgaggaaacggtggcatagagaggttaagcaatttgcctgaggtcacatggctgcctggcagagccaggatcccaacccaggcagtttcactgtggaagactaggttttaaattccacattgtgtggcttctcataaactccgctgttgattctcaaagccccagaaccttaaaggctgagctgcccaccttggaggagctgtctccatccatcaggagggggtgctttgcaccgatgctccacacacatgtcttcctgggtatactgagaatcaccacattcatctgctgtggctgggggcacacagcagggcttcctgcaagatactaggtaatctaccaagacacaggaattcagtgtcatctctttctattttggccttctcacatagaatccagcatgctattagaatcgatagacttaaattgctattaacaaatgccaagtgttctttgtttctccttgataatgtaaagacagaaaggcctagaaaatgcacctcagtggacagcttgtttgggtttcttgctttgttttgctgtatctcatcaattggtcagactttcagtcatctgatcatttcttcacaatcaggttgggccaaacagggatgtgtggtaccaaatccaagatgatgacagaggatcgtgtattcagggggctgtggtggtgtcatcctgtttcccaagcactaggactcgttgtgattttactgtgtagtgcagtgttccatttgagctttgttcttgtgggaagtgcgtctctaagatgttaatctcgcaactttcagtaactacactgggggaggatactatataggataagtgcattcattttacctccatatttatggcgtgttttaaatatgcaaataagcgggctacaaagtacattctgtttctctaaaaggctaaggaagagtgtttcactcacagaaacagctttgaaataacattggatgtgatctgatgataatcaaagagatgataattttttctaactcaggagtcagcaaactgtgacccatgacccctatttgtctgaggttctcaagctaacaatggttttcacatttttaaatgcttgaaaaaaatcaaaaggaggatactgttttgtgatacgtgaaaataatatgaaattcaaatttcagtgttcataagtaaaatattattgaaacagcaatgcccattcatttacatactagtttatggcttctttcacagtgtcactgtggaattgtgacagacactgaagggcccacaaagccaaaaatacatgactatctgaccttttacagataaagctgctaactcctgatctaactgatgaaaatttctctccacccggtttttaggatatcttatttcaaatgcatgcacttaactttcattctgggaagtaaaacagttggcttctcaccaaaaaaaaaaaaaaaaaaaaaaaaatttttcaaaagtagaaaatagtagcaaaaaaagagaaaaccattgcagatggtaagtgccctatctggtttagagtcccagctgacttctcactgactagccacagccaaccaagacactgaacaaaaggatacccaccatgcaattaaaccaatgtgcatgaaacacctactgaggactaggccctgagattggttttggggatagataccctggagaaaaagaaagacggtcctgatggaatggccttgctgatggcagcttaagtgttttccctcctttttctcacgagctgaaaagtggaaagacttcctctctctctcccttctccattgttcccacttccttacttcatcaacccctcacacgtgaaggacgttaatgcatctgacttttctaatccttgactgtgtgcttgtttgactcatgtctgctgtgtaagcaaaagatctctggaggtggaagaggcctggcttattcattaaaagatatcccctaggatctggggatttaagacctaaggtcaccaattgtctgtacaattgcacctgggagacagacccaaaacaggcactggccactctttctaactccttgagcttccatttaatgagctcttacttcatatcaggctctaggctcattagtattattttttacaatagccctataagatcaacagtatggttcttgttttaaagatgtgagaattaaagattctagagaattcaggtcatttgcctgtagcggagaatatgcatactcactaaatagccatgtaattctgtttcccagcttctctctcacctaagttgggatcacgtgtggattctgaccaatggcataggaaggaaagtaatgtcaccatgacattttttttgcaggcctggccctgcaaaacactttgggagatctttcttctctctctccctgaaggagccttggagggcatgtattccaaaaactacaggatggaagagggccaccctaccctctcagaatttgctcaagtgagaaataaacctgtgttctgttaagcaactggaattttatggccgctttgttactgcaacatagcacaacctagtggtatggatttgaacccgagtcactctgactccaaacctcctgcccccagctaccatgccatcctgtgggaggtctggaggctgtttctctacctcccagagggtcagaactttcttgttttttactgtggtgagttatcgctatacattttgtaaaataatgaattcaagttgtcttccaattctgtcagtgttctgaaccctgttgatacttaaatcattcttgctagatgactgactaaatgacatgctgtgtaaatagactgtatcagtttaccctcctgaatttttattacagcatctatgtgctaggattatttgagacaataaccagctctggaagagtactttgagaaactcatggaattgtggaacatgcaacaaaagacatcttggagactatgtagtttcaccccctcattttagagatgagaaggcaaggagggtctgagcgggagagaggcttgtccaaggtcatatgacaaacactcatagagaggtggccagaggcagggctcctgactctcagtgctgaatcctagaaactttggccacttcaggagatgaaaggcaagggccagaatgtctcaacagtaatcccagcattaatcacaacacttccttgtcgagtgttcactagatcaatctaaggagagggatggatgttagtctcatttagaaacaacttgagacttcctggattcctcattttgacaccaaatgctccctgggatcaaatgtgatttgaaaaaaatggttggagtgtttgtatgtggttttctcctttaaaaaataaagctaagggaaaaagcctcccataatgtgttggcttttggcagcttttacaaatagtggtatgatgagaaacacatggccgaccagcgcttggtgaatggttatgagggttttgctgccccctagagaaccagaaggccaggctgtcctgctccagaggcctgacaacctcccagccactccatctcccagcctgagtcgctggggaagctggtgaggctggtggtttgttctgggcagaccagcaggtctctatggggctgaggcactggcttggtgacatttactgggaggtaattgtggcacctgcctcagtctgatgggtgcaaaggcatctaaggtataatcctgggatgctctggaatacttgatggcctcacccttggcgcccccaccttggtaggcttctggagatatgcattttaacagcatcaagcgttctgctacctgagagtagtggattgttaggtcactaacatggcaggaatgcacttcataaaacctcctatacacaactgcagtccagagaaggacctggaccagcgggagcagagctcaggacagggaaggtaggtggagaggagggagtggagggagggtccacatccagccctgcccagctctatttggatcatggaaacttagaatctgatgaaatgatgacgaagtcagatgatgactcgcctctggaagaatgttcaaggacgcatggggcatacaattccagtgatctctgtccaccttgtggtcccaccgtggttgcagattggagacccctgagttagagaagcagcccaggaaaggcacagttgcactgggggtggtgtggtagtggtgagggaacctggctaaagggcatgtgaagaatcagagagcaagaagggctctgggagatatcctgtcacagagaagggaactgagtcctagagcagagaagagactggttcaagaggtgaagggactggctcaagaggtcacagcacatcactagcagactaggattgtaccccagcccctcacccctccatccactgcctggcaacagaccaaatgggcccctctgctcctcactgcttccactttccacttcctaatgatcatgacggaagcccccactcctgagtgccagtgttacttctaagagggaaaatgttaactgcgtcatgaactttcctctatgggtctcccaggcaaagtctaaactctagttattgaaaacagcattttttttcatgtgggatttcaaatcagtgctagcaatgaggttgagtcccggggagggggatggagtctgggctccctcagggcaattccagtgaagtggctggctggtgtcctcttcagagatgtgtgtgtgtatgtggggctgtcctattgatttaattaatgcacttatttagagtctatactcagctgcttccaatgggcttgaggtggctttttcactctcagtgtgcaaataagctgactgaatatggatgacaaagaatatttttaaggaagaatatatgattgtttaaggcttatttggagcatgactggcagttttaattttttaacagcaattcactagatgtgcaaccttgggtaagtgacttactctctccctgtcctgactgtgaaatgaggataatgatagtacctaggatgctagaaggatgaaatgaatcatattagctaagtgttgtgaatggtgcctgacacaaaatgaaggctataaaagtgttgatgaataaataaaactttaaaataaatgcaggatggtggtttttagtagtcaaatctcactaactttacttactcagtatgtcctgaacccttcctactcctctcccccgattttcctgccctgtcttggcttagcccttcattcgtcctgcctggacagtcaccaatggctccccagaattaattcctctatctccagcttcatggtcctctaggataccgacttccctcaacctctaaagtaggtcttaaaacggactccccacctcctgtgcttaatccctttcagaatatcccacaggactcactacaggataataccctacaggataaagttcatgcctcactctatatgtaatattatttttctagttttttcaaaaattgtgattgttttaatccttgataatagtattctttaatgaacaagtctagcttgggtaaattttagaagccatctgtcttctttttactgctcttttccatcagtagcaatgtgtcacccaacaagaacttatagctctacggtctatactctccctgaacctgtttgcagaagaggagctgctgcttttagttgatttttttcatctgtttaattgtggactcagaccagatttggtcaggtttaagaccctggatgttgttttaagtcactgggttaccctttcctgacttattttcattctgtcaggctttcggctctggttctgaaatgaaggaaactttgtcctcacttcaacgtcttccaagcaaagtgagctggagagaaggaacatactggggcgagggaggcctggtatcctagggctcctaaaatcactctgtgtaggtaggagtgactggctcttgttcataggccatatctactcttgagtggattttgtggagtggttttgagattggcagccctttgggggtcctaggctctctctttgaagaaagggtcctgttctctggactggtgaggttcctttggaaatgcatctgcccgaagttaacaccaggactttatagatccagcatgaacccttcccattcaacagccccagaaagaaacagatccttacttttcaggggtcaaggtctcctccaggaactcctcgatcttattgacgtctgtcttcacgtccccgttgaaggtcaggaagggcgggtgcgtgccgggggctaggttgtgcaggtcagctggctttctgtagagagagcaagattcaggtgttggcttacagcagggtgcttcctgttctgggaaacctaagattgattgtaacttagatgccctgtgctatccaacatgcctgtcaggtgaaacagatttatggtatgcagtatagggcaggggaggttggagaaagttctgaaagaatgtggtgtgacccaggaagtgtgtccagtggagtcagtgagagaggaacaagtcaagatgaaggagttgaaaaaatgaaagaattgaaaaaatggagagaatccaggtgactatctaagtcagatccaagctttaattacccaggggagaggtggggttttgcttttaaaagctctttcaccaatctgcctaacaaaaatgcgctacacataattccatactttaaaaattaatgaattagatcatacttttctcctaataaatatctccagatacaaaaaattgggagtttgggccatttgttcaagttagatgcttctattgtgtgtaacttatattttaatatctaataactaatgtctaacattggtcagccttttgtcacactcaacagaatactctttttgagttataaacagcccctgatatggtctttgggtagccaggaaaataaacaaactattagattgaaaacaaaactattaaatgaagatgttttcaaaagtcttcttattgctaagattattgctccacaaacaccaggtaggctattaccaaggattctgaaccaagaacctcctactggtgagtaagaagatacctgagagaaagccttacgattcaagctccatgagggaaaggacccagaaccatgcctggcatataggaggccctcagtagatacatatttttaatggctacatgaataaagcatgcatttttgattcagctacagtggctcatgcctgtaatcccaccactttgggagggtgaggtgggaggatcacttgagcccaggagttcgagaccagcctgggcaacatagcaagacccccatctttacaaaaaaaaaaaacaaacaaaaatttgctgggcatggaggcatgtgcttgcagtcccagctacttggaagactgaagcaggaagattgcttgagcccaggagttcgaggcagttgtgagccgttgatggcaccactgccctccagtctgggggacagagtgagactcggtctcaaaacaacaacagcaataaaaactcatacattttaaatttaaaaatgagtgattttagctgcaaaagtagaaatcaaatgttggtctcaaattggtaaaaacttcaatccagttatgaaggctttcggctttcagttaaatgtggggagaaccagtaggcaactccactgctacagtattcatgctccaccatagtctacctttcacagtattttaacttaattcaagcatctactgttctcaaaataagacttattttgagaacatttactagatttactagaaagaagttatttttctttaaattttaaaaattctgttcaacatacataaatcaaaaatctcctaggagtcagaaattgtgcctatttttaaaaattatggggttacttaaatgttatcttaagttaaaaacaatttattttctaagtaaatgcaacttctgctttgtgatgggattcaaatagatcacttgatttatgaaagttatttcttcttatagcaaactttgctgggcccagtaggatcttttaggtaacacatacatatatatgtaataggcagcaaatttgctccctaagaagacagaaagctctttggtgtgcctgttagtttctgggtcagacacttaaagaaatccaagataaccaaagcaacagtgcatttctcccccctgggaaagaggagacccaagagtcctaaattatcctgaaagaaaggcctagatgatggagaagtgggtgaaattctggaacgcagtcccaattgaatgaatgaacaattaattaactgaacaattaattgaacttcctgcacttagcccacagcagtgctaagtggcatttctggcgtgcactggggagcacactgactacctgcaggaaggccaagtgcagtggaaaggaaagtggccttgtgtttgacacggctaggtcctgttaatatccaggagtgtgcttctgtgtctgcgccagctggtcagaatgcaagagcaagaatggagcaaaatgagggggaagaaggtttggcagattggggaaaatgggaaaggggagggttacactaaaaatgtttagggaagaggagggaaaatggtggcgacttccaagacggtgctgggattcaccccaaatgctctctctgagaatgccacatttcttgtgggagtcgggagtggaaaacattaaacgcagaaactgtaaaaaaagtaaacagtgggagtagaggagtctgtaatgaaacaaattcctggcgtaatcagtttgggaggggaagagaagaatttcaattactgtgctactcccatgtccctccccaaacacacacactctccagctgcattctgaggcacttggaactcagacaactgagacggaaagtatttttaaaatctaatttacttagtccctttatttactttgtgcatgtccctcattttagacaatgaaaggacattctttatttgctcctgttttttagagctgacacaaggcagcaacgtgtgtgctctcagtcacctctctgtggcttacagatacaggaatgtgtggtggtggtgatggtggtggtggtgggttttttcctgggattctggagaattgtggccactggagtcagacgcccttgggaagtactgcctatggccaccgacgcttagctagagttgcagccctctgtctttgttgaccctgcttcagtatttatagttgagactatatcattagcattggatgacgtattgccaggtatgatttatgaattatgtaatgaggatcggtcttcttttccttactggattgccagctccatgaacccagtgataattctaagaataaccaacatgcaacgagttcttgctatgagtcaggtacaggaccaattgcaaatgttttacatggcctgcctcgataaattctcacaataatcctattgattaagaagacactgtctccattgtacagatgaggaaactgaggctctgaaaagttcaagattattcagtcactaaagtgtagtgccaggaaaataaatcagttttcttagaaattaatgtgtgtgttcatgggtagagggggcagtaagaaagtttccttatctgtaaaaatggagtggtgctacatgcctggtctacgtcaaaggggtgttggctggaccaggtgtgatcatgtgaaggaggaaccaaaccatctgaagcacgcgggcaggggtggttccctctcccactctcttctccagcaaacatacaagtcctctctcacacatggtaatccaaacacctccaattctgcactgaaggaagctgctttttcataagtctgctgctctctttagttatcacagacattaattgcatagtggatgcaagttcatttatttgacagatagtatttgaggacctgtgaaaaactagtttctatggaggatacaaacaaacttaaaacacgattccagtctgtccttgagggattgaaggtctcatttgaaagatgaaacaaacttcataactgaggtattatgaagagcatagtatttgaaccaagcagatggcgtttagcccctctaatttctagttggcatcttgggcgagtctcatatatatctgtctcagttatttctcaaataacacggagaagtaagacctccttcacaggattatacattatgtgatttttttttaatgagaaagcatttaccagttgtaaagcattaggggtgcagacctcagaacttgatgaaacactaaatcacgacacaaggcaacatagacaacaggtgctgggtgagtctggagggaggttgggttgacaggtgtgcttgtatgagtgtggtgggatgggtatgagtaggccttacagaggggatgggctgaagctgagcctggggccagggacaagaaggaagagagggcctgttttagacagaggatgcagttctgccaagggatggaggctcaaaggaagaagaacagcagaaggcaggccagcctgacagagtagacaggtcacggtgagaagtgttgggaaagagtgttgggaagaatgaaggaaaagacaaatcggggcttcggatgcatcaagtccatggacaatgggaaacatcaaaggtttcctgtgcatgaaagtggcctgattaaagcattattttaggaataataaccttagaatcacataaaggatgggtcagagagagagaaaaagagaatgtgtgaacctggaaagatgaagaccagtttgaagaacaatgagactctcagggtggcagtggtgagacttgaaccagttgtaggctttgagaatgaaaaagagagtttggaggaagagagagtgcaataggagaatgctctagacttggctactgatcaacaatgaaggcagcaatagaaaggagcaggaagtgtttagtgcctagaaaatagaagaaaaagaccaggagcagtggctcacgtctgtaatcccagcactttgggaggtcgaggtgggtggatcacaaggtcaggagttcaagaccagcctggccaagatggtgaaaccccgtctctactaaaaatacaaaaattagcctgtcatggtggcatgtttctgtaatcccagctactcgggaggctgaggcagagaattgcttaaacccaggaggcagaggttgcagtgagctaagatcgtaccactgcactccagcctgagcaacagagtgagactctgtctcaaaaaaaaaaaaaaaaaaagaaagaaaagaaaatagaagaaaaaaggagttcaagaagagctcaactcagaggaaaaggatacaaattgatgtatgcaatgttagacatacatgataagagaacatccaagtgaaactatctagatgatagcagggctctgggtgtagaacaattcacataaagataacaaggagaatatgccaagctcaccagggatgaaggtagaggcagaagatgaacacttatggggtgagcctcgagctgttccacatttaaacaacaggtagaagacaggaaacagaatacattctgtaggagtgaaaagagtgtggctcctggtgtttgtaagtcattaaactgcactctaaaaacagaacagtagttgcttttcgtccaagcctgtaatctagaactgtcacactgaggacttctaaagctgggaacatagcatgggaaagggtctagatcacaactctctgaagactcagactctcacacctgaagtcctgctagggtcccacggatgatggccttagtactactgaaatgactaatcctatgtttttagatgtctgtgcccatatgtgcaccagaaacttagttgcaatgccattgtccattccttgcttcttctttgctaatcgtaacttgctaatcgggtcagtgaagtgctgggcaccaagtgaaatacttgcctttgcagactctcttgtagctaagactggatcctgagacacagttctggacaatgacgtgtgagcagggggctgctgggagccacggaaggcttttgccctccttcatggaaggttctctgttcatgcagctaaacatactcctcatttatgcaacgtacgttaccttttcagatccacagtggtgacattgaacacgactcctttcagccagaggatcatgaagaggcgctgagagaaaggacagttgccgatgctttctccatcgattccagcctggaaagaagagaaccagtgtcctgagtgggcaggtgcaattagcaaggggaacataagattgtaacacccaaatgcaggtctgaggagaccttactaaaaccatgtcccagcaacttcaaagggcggtagcctgatattattagtttttgccttaatgtccacgcagggcaatgcctggcagcatgtaagggctcaataaatacttgctgaattgaacttgatgattatgcagaatcataactttatgaaatcatagaacccttggggtaaaaatagacctgcaacatcacttagtctgacacaaatgatattggaatgccaacatctacacccccaagtaatcatctagtttctgcttgaatatctccactgaccagtcagttgtattaatatctctcaaagcagttcattctgaggattgctctaacaattagaaatgctttccttcggctacctagccaaaatatgttcctctgtagtttaccctcccccacccctcagtccttggatgtcatgaatataaatatctcagactttgatcccatctccctatatggaggctaatcaggaagctcaaggctttaatcaatacaccacttagttctggctagtacttggccttcactgtcaataatccattcatttgttacacttttactcaacaaatacatattgactatcagttatgtgcaagacactggagaaaattagccaggggattgaaaattgaattcctccaaggagcttatggccttctgtaggtgggcttggggataagacaggaacatatgtaaaaataacagaattattattgggtgttctgtgcttctgtcatttcatttcccttcctcaaaacagtaggcttttttaggtctgaaaagcaagtccatctttactgcacttctgagtgggctgcagatccctgaatttcataaagaattaatttcaagcaaacctatgaacaaacaaaaaaggttggggaattggtctctgtagaattcatttccatagggtggtttattggcccccaacataatacttagaggaagaaataacccatttgctccagactctgatgttggctgccctggaaaccatggcccccgcaggtggcctggcagggcattccactgacaggaagggcctgtgtgggccagggtactgaagactcgtacaaagctgtaaacaatccgaccaatatccaggaatgggggcttactgagttttttttttttttttttcaaaagaaagggagaaaacaaatgcgttctcgaagctcaacacactgttttctcccttgaggtttgttttgctatggcattcagatggggaggcagcgatgccttctttcatacattagaacctcattgtgtgcttttttctaccttgcaaattgctcccagcaggggctcaggtttataatggaaaactggaacttttgacagtgttggctgcatgtaattgctatgaaattacagttattttacctccctcttaactacaccaaaagccccactccctattcagttctcacttttcctcagtgctggaagcagacccacccctgagtcttgagaaagcacggactccgttatataaaatgggaaaggtaggagggtacagtgtgggcgctacaccttcccacggaggtaaagttaccaataaagcatgctcagacaggtggctatcaatttaataatagcttggtgctaacttgagtttatgatgtacgttccctaggaacttctcaagaagcacttgacaggtaccaggttctcggtcctttaagacatcccgacacaggaagaatttccccagggccagttatggtggaagtaacaagaggagaactgaagaaaaaagcaaaaacaaaaacagaagccagatccatatactgttatctgttttcctctggtggtggtggtgggaggataagggaattgaaggaggaactagcaaaatagtggacttctcaactacataaaaaattcatataataataatgttaataataacatatctatattgtcaggcattgttctaaaggatttacatatgttattaacttgtttatttctcctgagaagcctgtgaagtgggatattttcagcttttacaaatgtggaaatggaggcacagagagataaaataactggcctaaggttatcatcgtggtgaaaccaggacgaacgcaggtggtctggctagagatccagtgctctgagctgcatgcctggagccagcctgagggtccagccaggtaacaggtcctccccaggtgctggggagggctggtgttgaattgtatggacatcctctggtcagtgtgcaatcagctatgccaggagcatagggcatggtatccttcatggctccctacattttcattatgtcttattaatcttgtattaaactatgattctgggtttagtaaacaaaaattgtcaaagaccaatagaaatatgcgaggatgctaccatttactttcactgtctgggtgtccctctttcagcttcttctattccccttcaaatcccaacagccttgcggccctaagaaattgtttgttaaactcatgggttaaatatcgtgatctgtgacgaccatctgaaacatcaacagagaagaaccaggtggggctcagttgggccccacatcctgaaaagtgtgagggaaaacccaggtgtactttgttccagagagattttgagcactgggggccagggaccggcacaaaaacagtgtcctaggttgaatcatgttcccccaaattcatgtccccctggaatgtgtgcatgggaccttattgggaaacagggtccttgcaggtggaatcaacttgaagatgaggtcatattggattagaatgggctctaaacatgactgatgtccttacaagaagagggaaatttcggcacagacatgcagaggacaaagtcatgtgaagatgaaggcaatgattgaagtgatgtatctacaagccaacgaacgccaaggattggtggcagacaccaaaagctagaagagacaagtagagcctggctctgcccacaccttgattttgaacttctggcctccagaactgtgagagaatccgtttctgctgctatcagctatactatgtatagcaatttcttggaaactgatgcaatcagggaagtgtcaaaaagacaattatatatatatatatatatatatatatatatatatatatatatatatatatataaacagctaatggcaaacttcccaagctcatgattctgctttgaacatgattgccagctataatcctaaagtacttcctgttccctagatacagtgtatataacaacttattataaaatatcatgccacatataatattccatatggtgataccagtagtagtagcataatgtaattatataggctgtatgattgcacttcatctgttatatgctggatacttcatattatatgctattatatattgcctttcatgtgagctctctccatatatgatgagcttggctccctcaaaacatagttgaagttttatttactttgtcttcagcagcaacaagcacaggcacctgaaacttactttatattcagtgcctatttaaatggatgcatgctgaggggagggtgatgtccctccctttttgtggcttgaggatctcaaaattctctcactgacattctgaaaatcatcctaaaatacatgcatacatactacatacatacatacatactacatacatacatacatggttaccctgagttatgtagcacactagccggagactgtggttctagatccatctctgcctctacttcactatgtgaattaccttagataagttaccccctcttggcctcaaccactgcacctataacttcctgcaattttgtaaattcaagtggaaaatggagatttatttaagaccgcggttctcaaactttttagtcttagaactcttttatgcttttaaggattgttgaggatcccagaaaggttttgtttatgtggatgatagttattgatatttaccgtgttgtaagttaaagctgaaaaacatttaaatatttagaaaaatgctataataaatgtgtctattaacatacacaacatcttaacacaaaataactatattttctaaaaacaagaaatttagtaaaagtggcaatgttttatatttttacaaaatctttaacatctgacttagtagaagtcggcttccacatttaatctcttggtatttagttggggtatatggggcttttgttgttgttgttgttgttgtttttgaaacagagtcttgctctgtcatccaggctggagtgcagtggcgcgatctcagcttattgcaacttctgcctcccaggcagtaaatactgacaaatattaagtctgagtaagcatggtgtgtcagccagttgctctttcaggtaaaaactgctttgtgagggaggcagctggttcagctggcaactcaatcatacaagtgcttttccttccacaaccatcagactttggaatgcagccaaagagcttatgtgcatttcccatttcatcaaccagaatgtttagaagacatgtatgcaaaggttgagatttaatcacattatataatttttaatgcttcatcaaggacattcataattgaggctattttttttttctgcacatgcatgactggctagtcacacttataccactgcttggatttgtgctgaaacactagtaaacttacccacgaaataccaatcccagagagagaagcataccatattgatataactctaaaaatagttgtgacctcttaaaacccctgaaagcctcttagcgaccccagaagtccatgaacaacattggagaaccattgttttaagacattccatgaacacaccagatatgtaatacttggtttccagataatgaaggggaagctgataattggccaaaagtcactcgcgggtacccaagtccagaagtgggaggaatcattcagagaggatccaagaaggaattatagaaagtgaccagatgacattgaagcttgatagatgagtcagttatcaatttattgcctttcagctccaatgcacccttgaatatatgctctgtgagaacagggggaatttctttaaacatttctcctttaaagtgagcacaaagttaggctttctcaccagggagaactagaggggcactgcaggaggaagaggctttcttgctggctgtggtgtgggctgggggtgggcagtgtagctgtgagggcacgcagtggagccaccccagctataggctcagcatgcaacccccctggcacctcatagcctcagcctggcaataaccttcccagcactcttgacacagaaaccaaagtccccattaagcctatgtccagtcggcctatggccagtgtgtccacacagcttggtcaccccctttgcaagccccacgtgtcctgaaggccttcttctccactaacacctagatcctgctgcatgctgtaccgatgctgattgcctgctccctgcctgaactctggggagtgggctattgcttgctcagcgactccagaccagctctggcctgatcaaaccagtgagtttctgtgccaggttccaaaccacttctaagtttgtccttccctggctcctctccctcagccctagggtaccatagagagtttccttatatgtcatggttactcttttatcttagttaaaacttcatgttgaatttctcctgtttaagctaccatgtagtttctcactcctgattggacccagactacatcagatgcttaaatgtctgttatttcaaaatgtaagatttttgtgacctttgacttctttaaaaacctggcaaggttaagtcctggatgaagtattaggaaagaaacctcagttttctcaagaaagataattaagtcaccacttacgtcacatttccactttttgttgctgtcgcccatgaaacttgtccctgaggactcaagtgattaaataattttgttaagtgtacagataaaaattaagcaacagtagggctgtaactgacctcaggaatgctatactccagttctttctttttactggtagagaaatagacccagaaaggttaaatgaattgcccatggtagcacagctggttcccatagcagaatcaggtctctctaactcctgactctcagttctgagcagaccacactggctgctgtcctctagaaaagagtgacaaagtggcaaaggccacatgaaaaggactttctttaaacataatagctcatttaaactgtttagacaaagaagctttctttataataatatttccagctgcccattttttaattagttagtgtaagtcagacaacatttctagttgtgactattttttttttaataccaaacagtctatccttccaataatttggttggcaagacttcaattagcagggatgggacttggtggtacgtggtccacatgaggacagagaggtctacccttgaagaaatcaacatttcctttctcagaagccacaaaaggcctaattcactggggtcacccaggcatttttcattcaagaaacaggtaacaggtatacatttgaggctacagagatcctcaacatttatctaaagtttaatgtatgggcttaattagctctatgtagaccactacctgtgcaatgtgatatgaagaattctaggtatattggtcagagttctccagagacagaaccagcacaacatgtatgtgtgtgtgtgtgtgtatttatatatacatacacatatatgtacatacacacacacacacacacacacacacacacatcctgttatatctactatatatggagaaacgtatacacatcttatttttatataatacattataataacataatattatatatatgtgtgtgtatatatatatacacatatatataatacatatcagttggggtgtgaagagagagagatttattttaaggaactggctcacacagttgtggaggcttggtgtgttcagaatctgcagggtaggccagcaggctgaagccccggggaagagccgcagttcgagtccaaaggcagcctgctggcagaattcccatttcttcagaggagggggtcagtctttttttctatgaggcctacccacactataaagggcaatctgctttactcaaagttcaccaatttaaatgttaatgtcatccaaaaaaaaaaaaaaaaaagcaccttcacagaagcatccagagtaatgtctggtcaatatctgggcactatggcccagccaagttgatatataaagttaaccattacacctggcatatttaaatattttacttgattcaggtaacctattaattcagtagctgtcatctgcaccttagctcaccagatggttttgtaaacaattgaatatagttgtgtacatgtcccctcccaaaagaacttgtaggctccagacttagcgggctccttggtttacgcctctaagtgagcaggatccagtggtgcctttgatgcataactagcctggtctgatggtggctttgggcccaaggctgcctacaactttgtatgttgcacagtgccactgtgttcatggcccattggggtgtctgtcctttagcctgccttgagctttacgtccatctgccactgagtgtatgttcaccctcctgtgcttcacacactctctgagaaagaactgccctttccaactcatcaccactgtcccttctcccagccccttctttctactcctacatggcttcttttctattatttcatgtcccgctatttgaataaatgaatgggtttcttttaaacctcttgccagcctttcttctatttaacaacttctgaaattgttgtctttcaatctgtttccgggttaatcaattcttttttttttcctttgtgtcttcatcctacctgatattcgtcttatagctaaaacttttgattatcctttcttcttaaagctcagccatctgcagcctcccttgccacttggtgcctcttaggtgggaggagccagcttaacaggcaggcagtctgtgcagttgcatggggccccattaaacttggtttaatgctctgctgttgctatcctgaaattcttaataattttggagcatagggtccctcattttcatttggcagtaggcactgcacattatgcactggcctgcctgtggaccccttatttttcttgctgacatcctcctttttctggcatttgccctctcagctcaccactcttctcctccatgcttggtgctctttggagaacttaccttgagaacatgactgtccttcccaagtcagcaataactctggcttctaggcctataaacatgctacttaccctaagcttaaaaaaaaaaagtagaaaggaaagtcagagaaggaaagaaaacaagggaaaatgttgaaaggcttgcttggctcaagtctcccttgttggttccacctcctagcctatctcactgcaatgtcatatgttattctagaatttgcctcatttcaattaaatatcttgccagttactagatacttgaggttttcttataagtcagacaatatgccttgttattactatttttcaaaactaaatgatctgaccttccaataatctagttgctatgctccattagcatgaatgtgactcagtgatttgttttatttatctactctcagaaacctgtaagtactcaagaaatgtaagactgatggccttggtatgtcttccaagtgattccaccaatcttgggaaggaagaatggttctcatatgttaatattatcaaccttcaccatgccttgggagagcccaaagtccacactctctgcctccaagtttggctgtttctgctcactagcccaggtgtaatatttaacagctaaattccattgcagtagaggcagatttcagtcctcagcttcacagaatactgtggtacagtattaagggcattgtatagactcatgcaaacctgggttcaaattcctcccctgacaccaaccagcagaaaaaatgtctgcagcactatttccaatcccgtatgtccttcataacctttccacagccccagctagaggtggagtccacatttcccttcttcttaaaatagggcaggcttttgtgactgcctggatgaatggaatatggcagaagtgacacaatgtgtgacttctgagattaggtaatagggggtgatacagcttctgcctgtgtctctctctctgtctcttttgggatgcttgcccctggaacctagccaccatgttgtgaggaagcccagagcacatgaagaggttctctgtagtgttccagctaatagtctcagcaacgttttcagatgacagattgcctcaacaaccagacaagagaatgaatgagatttcagattattccagcccccagcttttgaattgtcccaaatgacatctagtgaagtaaaattagccattctaaccaagtcctggccaaatgcaggtttttgagcaaaataaatgttgttattgtttaaaaccactaagttttgggctggtttgttactcagcaggcaactcacatacacacttagcttcaggccccttatcttcaaattggtggcagagttgtataattggatgacaatatgtataaaacatatagtatttactttatacatttacagctactgtctttatggccgcagaaggcaaacatttaggaagagcttgttaaacaccctatttatgaaatattatgccttgatgaagagtcaatagacctctctttgatggcacaaaagttcaacagtacctagcgttcagggttttgtgtatgaagcaataaattcaacaaagaaagaaaatacatgaagaactacagctattgttcattggccagaggagagtgttcctaaactaggtcagtcatgcatttactatgaagggagagagggaaaagtgactcatgtttggttaactattggtacaatgatagatacatgcatgtctgttctctataagactattgaatttctgtgaaaagcaacaccctccaaccaaacacctttttcaagtagttcaagagtcaaagatgagaagggctggaacccaaggaatatagatggttgaagctaagggatcaggtccgggacagattcctggaagttttctattgaagtttattggaagcctttgtgttctctcaacatccggaaacattttcacagctctttaaggtactgtcatcctattctttagacctgattaaggctctcaatgcttggttcaggaaagttgaaatctggaattcttccacctcagaaatgtaccaaaacacaggaaaccaaagagcaatacaaatctatagcctcaaataaacagaactcctttccacattggtataatttgaagaagaggtctcctcacttaagcctcccttggagaatccccatcctaatacaggaaatatgttttccacttaatgaggccactgtcaaaagctttgctttcctctcttgacatttttcttatttgttatccaagatgctatggaaattaatggcagctcttgatcgtgaatccattccccctatatttaaggaataagcctgcaattcctataatcctcataccaaacaaggatatcttgatattgagctctgctactcctacaaaggttggtgtttgggatcctgacatagctgagattcctcaattattactcatctgcccttctgttctggttgtctgaatgttgagttttgaatatagcctcttaataggataagctgggctggaaagactttagagacatcccaaaatctgtcatcctagctctctgttggcttcaataatcactcatgaatcccaaactcaaatataacaaattgaaagcttatgacactaaaatgaaatctgagtcctgaggtttattaattagggtcatgtacatctgagaacttatgaaaaaagtttttgcaaaattactagtttatgatatgtcaacaaagtatgtttttagagctcgaaaattccacacaactaagcattttaaaaactggaatgcccaagccccactctcagatattctgatttaattagtctgggggtagggctcagacatcagaattcttttccctcaatgttctcgaggtgattctaatgttcagtcaggactgacaacttctgacctagtggtgcccacagtgggagatgtccaacagaatcaccaaaggagcttgttaaacaaacaaagaaacaaatgagctccctgacctcactgtagacttgcagcatcagagtctctgggctcaggagatgtgtgacgggctggaccaaccaccgacagtagcacttaggacgttgtttctccctcctctttttgtttcctttttccttacctaaactggaaactccttcacatcctggccccactcctacttcccaccccatttctacactgttcttcttcaccttccatccctgcacaggccctgaaagaagtgcaccattttgagttgttcagggcatggagagcccattttggatcaagatgtctgaagaacctcaagtcaatgcagccataaacaatgccaagaacttcacgtgccaactgatatttttatggttgcatctccacacagaactcttaagttctgccaggtgggtcttccctgagggtgacagagtgtgctgtgaccgggtacagaaaccctagtcactgggctcaagttctcatgtggtcaaccacaggccatatgtacccaaccacatttgttctctccagccaccttcctctagtcagccatggtgaaaaatgtggcttcttaaaaaatgcagggtcctcataaggtcctgttttgggctttcttggctgcgtggagtaccagcaagctgtatctccactctcaactatatgcaggcacttggccacttgggcagggtggatccacacagccagatgggcatctttaccaagggccagcttggttccagagactggggatgtagtgatgtggtgatgaaagagacatggtccctctcttgagaagctatcacacaacagaggcagcaaaaggtaaagacatgatggccaggtcatcactgaagtgcagtagtagtagagaatgggtggagtggggacaggaaggagcccacctaagggttcacggaaggatttggggcagcaacaatgcctaatgtgagcctcaaaggtaagagagtttattcatacaaagtggcaggtaaggccatccaggcagaagtgatggcataagcacatgcctggaggctggattgaacaatgcaggtgtattaggctgtttttgtgttctgtaaagaaatacctgagactgggtaatttatattgaaaagagatttagttggctgatggtcctgcaggctgtacaagtgccatgccagcatttgcttagcttctggttagggcctcaggaagcttatgatcatagtggaaagcaaaatgggagcaggcactttccatggcaaaagcaggggcaagagagagagagagagaggaaccaggatcctttaaaccacagctctcctgtgaactatcagagcgagaactcactcattaccatggggagggcacaaagtcaggagggaaccaaccccatgatccaaacacctcccaccaggccctgcctccaatattgggaatcacatttcaacatgagatttggcggggacacacattcaaaccatatcagtgggtgtgcagggaattccaagcagatcttcttcatgctctattaggaaaacccatgcagaatttctctagttccctttcttcctccattctgaggaccccagcctagtcacaggcaaagccataaggcagtcaaatgctcatcttctgggggtctctgtgtcttcccaatctgctatctccaccatcatgcatctctaaacccctcagccactcttggccagcatgcctctccccacttgtatctctcaatgccaactctgaaagcattcacatttaagtatgaattgttggtaactgctaagcacttattcctcctggggtacttttatttatcatggcccagatgtaagcaacgagatgaagcttcaatagtggggttgcaggtgtctgccagaaactgattaaagaactgggaaagaaggaagaagggcaacaatagcttcctgggggtcctgaaaccagacatgtaggtttttatctattatctcctatgtgagatcctgccaacttgttacttctgcagctctgaaaaactagctcacacaatggatgccccagaccaaagggcaggcactcttatcacaaaactgccttaatttccatttaaaattttctatttaaaattacttcaaggctggttggaagggcaagacttcaaaaacaacacattcctttttaattaattggaggcgggtgactataggaatgttttagctttgccgttaatatgagtgctatgaatttgtaatagtgacatcttcctatacttgtgcagtaagatgtttgttagcaagaatgtttggagaagcaagatgttccctggtgaactgaattccctgggtagccctttaagcaatttggggcaatgtaataaaaagcagaagattaagagttctgcgttccagacctagttttggcacaaagagttgtgtgacctagggcaagtaattttccctctctgggtcttaatcttgttatttttaaagtgaataaattagaaaagatgggcttgaaagacactctgttcctaaaatgtggctaggagaaggtgaaaataactaaatcttttatttgcacctaaaaattccaatggctgagtagagactccacaagctactacagtcctctctcccagcaccatgcatggctcacagcacgggctggataaatgtttgccgagaggatgaaagagcttgtggactagcattctattctgaaaacacaggcagctggatctgcaggggaggggccagcactgtagattgcaaggaaaatcaggccacaaaggaagaaccacctgtgaccacctttgctagctgcttctgggctctgccttctcacaacttctctgtagcatctttccatagtattctcagcaccttaccttaaaaagcagttgaagaagcaccctttttggaaggctgtccccaccccatgtccccgcccccaccccctcctgctctatccaactccttcagactagggcagttgagatccaaagacttcagatgacttttccaaggccacatagacgatcggtagggatggagtttgctattgaatggagatggctgaaatctcagtcaaaatcgtgaacgtatgtaatttagacataatcagggaagacaggaaaaacagaactgaatcctttggaaagtcatcttcgagagatgttcctgctaacccttgcttatctttcattttattcccttaaaagagtaaactgctgaagacagaggaagaaaaatcctgccttgttattgaatggtatggattcacattcacatcaaggtttttttttttttttttttttttaatcgtggaggatttactcagggtaaagacagaaagccacactcctacgacaggtcctgagctcccaggggaaggatagaagggaagctgtgtagctgtcttttctcactatgttccttcttctcccgcctagggtgattgggaggattaggggagataacacaagtaaaatgggggcgcagtgcctggcagaaagcactcagtgcatctgccatcttcaaggtcactctgccctctgggcccattcctccttcctccctctcctcacccccagccagcacattaaaggtcacaggtctggagaaagtccttctctgccactgtgcaacagggaaatgtttctcccagccaagtgcccctgtcatgtgggcccacccaactaatttcttctgagcccctatagaacttacagtgaagactgtggttagtcctggatgattatatcttctgctttagaagggagctttgaaaacagcctcacaattacagaaaaaaccaagccagtttttgtgtcaagaagacccaatttcgttttctcagccttgaaaaaaaatcaatttgaacttgctgctggctgagttatatgttcaagctcagaccgagctgtaattggaaaggagtctgtcttttgtaatccccaggccaaaaggggaaatgaaaatctttttcaaatggcagagtaaggcaggaaatgttctctttattgtactcccataaaaaaataaacctacccagtaattataccacacacacacaatagtccaggccctcacccaggaagccacaacctgagatgaaggagtcagtggttattttcaaaaagggaatttttccaagccctaccatattttctctcacaagttcctttgcatttacaagagacagattgcccaccctgcttttctgcctgactggtggaagtcagacaacctgcatactggtcccagttgttctgcaagatgaatgtgcccttgagcaagtcactgtctcgatctggcattctgcacccttacctatgaaatgaagggacaactagacaatgcctacatctgaattctctgattctctttatgctcacttgttcattgggcacaaaggagtcagaggtgatccctgcttatgaaaagctctaatgtaaattctccactttatgtctaggagaaaaaactgaaagtggccattataaaaatacaaaactgccccattggtggactccaaaataaatgaggtacagaaattgttctttttcctctactggatcctttctgtaagtcttagaatttgctatgatgctcttggggcattcaaattcacaagcacaaaaagaactacattttgggtaccacattctaatactactatccacagagtggattcctcaaatcagccatctggtatatagaatatgtgaaaatgcatttccagttctagcagagattgttccatccataggtctagagtagaagtatatgtaatcgttgacaatcaacaaagcatatcacttatatcttatttagtttgaaggtgccgaacagggttgttgtacatgtttttaaaaaaattttattatggtcatctcgtctccacccaaacccccaccaaactatttctaccctcttaagccagggtgagccaaagtcccaacctttcctttacgtacaagacccacctaaggaaggaagcctgctattgttggactatgtttagaacagatgatgctacgtgatgaacttcgagcattaatgacagatagtcttctagatcctatctaatgtttaggatcagccccttcaaattgttttttgatggagcctcaggaatggcaaagaaacattgcaacttgtgcttcatctgccaattattgaaggaggctgctggaaacataatatagaaaattctgaggtctcaactaggattcgtaggacagaatgtaagcattatttggtgatgacatgttttatttataaagtcaaccttagatgcaattctgctgactcttctacacagagaagaggcctgctgaagaattaaaagataagaacaaagctaaaatgagaagcataattttcccctatgtcctcctagttagctcttatggacctttctgtaacatgagtttcttctactaagttgtaaaacagatcctgttttacttttctcttctcagtcctatgatacagttcagggccagacacatttactctagttgttcaaaatgtagcctgcatgaaaagaccagtgtctcagagacataccaaagggcagaacagaaacaaggcttagaaacaaatttaacataagtagagtatgggtatcaaggacttttactgtatagcgcttgcaattatgtgattagctttcagcaagatgtgttttctctctatcttttcaaccagaaaataatttaaaaaacaaagataacttgaattggcctcaaagctgtctccatccctgtaattgggaataataacagctgcccacctacttcacgagttctctgtgaggatcaaaggtgctctgaaaggatgacatacaataatggaacctaccactgccatatcctgtcttctttgttagtggattgaaattccagctagaacacaatgtcctacagctccagggtcctcttgtaagtttatctctcaatcaagtctcattaagagctttttatctctcccctggaactcccagaaaaggccctaagagggatagttttcttgttaggaggaaattctgggttgtctgcagccttgctgctcaaagtaggtccacagaccagcaacatcagcatcctttaggagctcattagaaatgaagattctcaggccagccccatacttactgaatcagaacctgcattttcagtaagacctctaagtgatttatgcctcttagtgtttgagaaggctggtcttcagaacctttgcaagataaaggcctcatacagcaacaatcggaagacctttaaaaccgatgcattgggtcagtgatagccagcttttctttttcatttaaaaagtgcatctttgcacatccagatttcacataattcttggttaggaaaaacaaaaagaaaaacaaaaacaaaactccactcttgttcatagtaatctggccctactgggttctaaaaatgtcagtgaatctctgccaaatttccatacctcgtgcagaggaggagcctgcttgcaaataacaatggcagccaggtgctgaaagtggacactgaagctgaaactggagctgaggttaaattatttattgaaattccatgacttggcttgtctgttagaagccaaccaaacctagagtcactgagcatgttcatctcgaacaggccccatcctgcaccccctgaagttacctgcctctttgcctgtgggaccagtcagatgtcggaccctacctccaggggttaagttatggaaacatgacatggctgggttagtaaactgggctctctaaaggtgctgtcctgagagctcctgatgcccatggctgagcagttcagtggcttagcagtctgcctctgtgcaacctctagttcatagaaagcctgcctgttgcaggaaaaataactcgcttgcagctaactctttcttttcattttttaaaatgaacaccctttgtctcagggtttctatttgtatgacagagagaaatgtgtttttttgtgggtgtttttgtttgtttgtttgtttttgccaaccaacatcccaatatatataaaatgaattaaaccctgtagatatatattccttttacaatataatcactaatatttgatcctcaaaagcaaaatactatgaaaacatgttcatcaatagcagaataggtggccgggcacagtggcccatgcctgtaatcccagcactttgggaggccgaggcgggcggatcatgagatcaagagattgagaccatcctggacaacatggttaaaccccatctctactaaaaaattagctgggggtggtggcacatgcctgtagtctcagctacttgggaggctgaggcaggagaatcacttgaacccaggaggcagaggttgcagtgagccgagatggcgccactgcactccagcctggcaacagagcaagactccatctcaaaaaaaaaaaaagcagaatagttgattacaatgtgatataaccatatgatagaatagtatacagctatttaaaagcatgagtttgattcttatgtattattctagagggagtgtcacagtaggagaaaaaggcaaatgacaaagtaataagaacagtgtgatccctttttgtatttaaaaacaaaatcttgcatgtgttcgtattgtacgtgtgagagagaggagaaatatatatagttttatatataaaaccaccaggctgggaatcagaaatcctgggtttctgtccttatgctcccctgagaagtgggggctgctcatctctgggcctctgacaccttctctgcctatcagtcagagtgacagcaagagtcaaatgagaccatgtgcatataagggctctgaccagtggaagtgattatagcttccaggcacctatggaaagatgaaggttaatataacaattatatttatatatagggcagaatgaaataaatggtaaataggagactcaacaatatgtttttcatgtcttgggaagcagtgtttactactgtgtgtgtgtgtgtatatatatatatatatatatatatagagagagagagagagagagagagagagagagagagagagagaaagagagagagagagggcatgccatagagaggagttgagggcaggacctgatactgataacatcagtttcttcaggtgggtgcattcaaggggtgtgtgaaaggagagtcttcatattttctttatgtggtttcaagcaaagaaatatttgaaacccttgggaacagatgtgtttcaaaattcaaaatattttggaatgtagaaaggtaacatgtgtggatatatatgtaaccccatccccaccccctgcaggctctgggacaccacactgctgtaatcaagtctgttataatcacatctccacagcaccaagtggggcaaagatggactacaaatcatctctaaagttcaaggaagttttgcctcaaagtgaatttccacaaacttatgaaagaacttacagttttcagagctttttgaatttcaggattacagataaagaattgtagacctatatatttctttaaggtttgagttgtcacagtcatcttgtatttttaaaacaaataaagtaagctaaaagggaggtgacaaaaaaagaaagaatatatgaagaggaaaacccctctgatctgcccttgggtccctttacttgtgcctccaaaggctctgatttagaactggagagtgagcaggatgtagctttggtgaggcacactcaggggtcggcctgacctggggactggaaaccccagcaaattcaagcccactagcctgccatgtagcagatacaggagaatggcaaataaagatgaaagaaagacttttaatgaaatagaaagtaacttaggtgccaaggagtaaccagatcctaaagtgatgcccacgtggctcctgtcattcgatatgcaactgaaacaaaagtatttctgtcaaagttaaaatgtatattttaactttggccaacagtgactgtccaacacatgtatagatggcatcctcagtccagtgtgccaggaaccagtggtgccctcagattctcattggggcaggcaagtgcttgtttctgtctaggtctctatcaatatggacatttattttaaatatatatgtatatagttatgttgctaatcttaaaaaaaatcttgaaatgtgctttaaatccaagtatatcagattacaaagaacaagacaatatgttacctgtcaatctctaaggtgcaactgctgtacaacttgagccaagttagctggagccttcatttctcttactatgaaataggggtacagtaccattcatcaccctcacttgaaaggtatacaatataattaaaaagtgcttaaaagtctttggcttaatttatgttgtaaattataaatagcctatttctctatgttatataggtaaaggaccagggcctgaatgtcataaagagaatgtaaatgatcagtgatggaaaaaaaaccaccagactgggaatcagaaatcctgggttcctgtgctgatgctcccctaagaagtgggggctgctcatctctgggcctctgacaccttctctgcctatcacaaagagtgacagcaagggtcaaatgagaccatgtgcatagaagggctctgatcagtggaagtgattatagcttccagtcacctatggagagatgaaggttaatataataattatattacgtatacggcagaatggaataaatggtaaataggagactcaacaatatgtttttcatgtcttgggaagcagcgtttactactgggtgggacatcggaaaagtgtcctttcatttttattattttcttggtagatttgttttttgtctgcttgtttctttctttgttaaatgtgtagtgtgagtagacatcccagcttgcctaggactgggggaattccaggactttcaggatttaaaactgggaaggtccctggaaaactgggatgagttggtcactctatgtacatgcatttctactttcagaaaagaatttgaaggcatggttagacatagaagcttacatttaataaaggttggtgcaaacgtaattgctgtttttgccattacttttaatggcaaactcattcatacaatgcccatgcacagacagactttattcaattcaaagcagttaaaaatgtcaaataaccccttcttagtacttttggttcatcgtactacagttttgtccttcactggatcaaacgtagtgattctcagtattaataatcactccagactctgtctaaatattcaaatgggtaatggacattataatggcatagacctatgaggtttcctaacattaactagaatagacaaaaggcagcttgtcggaaaataacactaacaacaacaaaagggatattgctgatgctttttagggctggatgttacgtgtgtgctgtatgtatgcaatgtgcatattgtcttcccatgtttggttgacttttcattgctaaatgagcaatgtagttcatacagatctgcccacatatcaaaagaataaattatttcctttcagggctttgtcttttgcaagaaagtggtgtttaaactatatagttgatttataataaatatttgtaataaatatttattttaaataaacagattgggtgattatttttatttcacccttgaataacaaggattatagtaactttttcattctttatttttgactttgtggccttttggattttgcatgctttttcctatgactccacttcaggtgtttatagtgaaacataaacctctttttatcaaattccagtgcaagctttaatgacaagcatattgtaattattcttgctacattcaaattgtaatgaatcaaaatggtatgtggctttttttgaaagatgatcttttagttgctatttcaacaaaccccccagatctggagcccagctaccttccctccatcttttgtaaattaaaaataaaaaaatggatatgatacaatatcctaaattatttctttggcccttttgagcccatactcagaaccctccaatgactttgcactaataataggataaaattcaaactccttgagctgcctctcagggaccctttctttttccagggttataaattctcccctttcaagacctcttcccctgcctcccctcccctctaggcaaacagcttgcccacctcctctgactaggctcaggttggctatgtctgcacttttgttcatgtcatttctctcttttggacagcattatctgtctctactttcaaatactaactcagaccccatcttccctggaaatcctcttcagactacttctattagaattatgttgtgtatagttcatttcattcattcacttgacaaatactaaacatcaacaatgtgtggggtgctgttctaggtgcaagggatgcccagtgggtttccactcagcgtctttccctgtagcttgctgcagtggtggggtttttctctggaagcaacagagcaagaagacaaaagacaatagcagggaagctcctgggctttgggtctgactaggctttgccacttactagggttgtaatcttgggaaagtttcctggcttcagtttgctcctcagtaaagtagaaatatggtgtggtacttaaaaagttgtggtgtgaatttattgtccatgtaaagcatttagggatagtttgtggtgcaaaataactgctcaataaacagcattacattatgatcttatacctggtctgacccatctatggtgccttttttcccctcagtgctttccatatccgagaacttagtgttgggcttccttgtcattgtgtgataaaatactcttctctttgactggggatggctaacaatgagtgattcctgagcaggaatcgtaagctttccaataaaaatatatgtggggattcttaaatattttaaatatttcagtgaaggtctatggggattctaggaagtattcaacaatatttattaagaacttctagaacagtggttctccaatgttagcatgcatcagaaccatttgaaagccttgttaaaacacagtaggtccagggtggggcccaagaatttgcatgtctaacacttttacaagtgatgctgaggcttctagtgtagggtccacacttggagaacatctgtactagaagttgggattgaaaataattatgaggctgggcgcagtggctcatgcctgtaatcccagtactttgggaggctgaggcgagtggatcacctgaagtcaggagtccagctgacccacatagtgaaatcccatctctactaaaaatacaaacattagccgggcatggtggcacatgcctttaatcccagctacttgggaggctgaggtaggagaatggcttgaacccaggatgcggaggttgcagtgagccaagattgcaccattgcactccagcctgggcaacaagagcaaaactccattaaaaaaaaaaaaaacagaaaataattatgagagagctgtggatcagccttccaaaggagctcaacagccagagtttgaaaaaaaatgcacaacagggtgggatacacaacagccacggaccaggttagacaacactaagtggagccctggttccattattcactgggatataaccttggacaagtcatttacctcctctgagctttgttttccttattcaaaaatgttagaataagaatcttccctttatatctcacagtgccatgaagacccaggacacatgtattatatgtgctaactgaagaccaatcttcaaagttcaggggaaggggcatttcctcccctttctccagtccaaagtaactccttgaatagacaagagaccctctaagcatgtcacgttctttcctcattcactaaggcattgttcaatatcttaaagactgaactagctgaatagattccctggtaactcaaaaccttaaagcagctttgaattaagagcctgtctctgggaagtgacatttagggaaggtccactaaggctatgtgggctccacccactcttccagccttctgccttgtcctgaatcacattgggctgacaagattagatattcctactgcataagattagcacctgtgaaaaatcattctccttgaatcacattttaatgccctggcctcagtttttacagttactagatgaaataatcacccaaaatttctactgcattttctatttaaaaaacgttgatggcattgttcattatatttttgagtgatccccacacactacttataaaccattacatgagaaatggccttttagacctttgtgagatgcatcatagtatgcaaatattttctcccgttctgtaggttgtctgtttactctctctgttgatagtttcttttgctatgcagaggttcttttagtttaaccaggttccatttatcaattttttatttctgttgcaattgcttttggagacttagtcactttttttttttttttttttgccaaggttgatgtctagaatggcatttcctaggttttcttctaggaattttatagttttaggtctaacagttaagtctttaatccatcttgagttaatttttgtatgtggtgaaaggtaggggttgagtttcaatcttctgcatatggccagcctgttatcccagcactgtttattgaacagggagtcctttctccattgcttgttattgtcaaccttgctgaagatctggccttaggcatggggctttatttctgggttctttatcctgtttcactggtctatgtgtctgtttttatgccagtaccatgctgtttcaggtagcaaataaaggcaggaacataaaaccaaatactgcatgttcttacttataagtgggaactaaacattgaatacacatggccataaagatgggaataatagacactagggactactagagggggtagagtgggagtggggtgagcattggaaaactacctattgtgtactatgctcactacctgggtgacggtgatcatttatataccaaacctcagcgacatggaatttacccatgtaacaaaccagcacatgtacccccaaaacaaaaataaaagttgaaaaaggagagagatggctttagaatctatcaccacaaagaaaagaatacttaatgttaagggaaaatgctagtgataaaatgttgtgaatagagcatgctgcaaaatgtatcggttgtataattccaataattaaaaaaaaaaaacctagaaagaaaccaaaacattatcagaagttatctaattacttttataaatagaaaaaaatatttttcaaagtaattcaatgacagggaatttcatcttctccaagaaattgtcttcttccactctcaaaaagagaattctataactcattgtgtcttttttccctccttgccttcttagaagctcaaagatcattatttgaagcatgcattgacccttattacaggttcatttagtgcttattttcattttctgttttgttttgttttgagacaagatctctctctgtagcccaggctgaagtgcagtggtgtgatctcggctcactgcagcctcaacctccagggctcaagcgatcttcccacctcagcctcctgagtagctgaaactacaatatttaccaccaggtctggctaatttttgtatttcttgtagagatgtggtttttccatgtttcccaggctggtcttgaaacctgagctcaagcaatccacccacctcagcctcccaaagtgttggaattacaggcatgagccaccgcacctggcctcattttctgtcttattgctatttcattttacacgtgcttactagatgagtagtatctacttatataatttctgaaattttgaaacatcctgaactttttacaaactaaataaggagccagaagtaagtgatatgtaagttccaagaaaattaaacaactagcttctaaatatacctcaaaaagtaatgtggtttctcaaggcttgtgctttgcagtgggcaaatctgatttatatatttatcaaagaccataatggatattacattccttttctgtaagcagttgatactcaatgagatacaatgtggactcccttagttaccacctctgtgggggccaggcctaggtgggaggaaaaccttgcactttcatattgctgttcagttttggtgggcatctaccaagggaaccactctggaggaagactctctgtctgatgaaatacaggggacaggccaggtgcggtggctcatgccaataatcccagcattttgggaggccaaggagggtggatcacctgaggatcaagatcagcatggccaacatgatgaaaccccatctctacaaaaatacaaaaaattatccgggcatgatggcaggtgcctgtaatcccagttactcgggaggctgaggcaggagaatctcttgaacctgggaggcagaggttgcagtgagctgagattgcagcattgtactccagcctgggtgatagagggagactccatctcaaaaaaaaaaaagaaaaaaagaaagaaatataggggacagtcaaggatgacactgaggttttgatcttggaatgttggaagatggcaaagacaatatgagaaacgggaaatgtgagggagctcagctttaggggaaggtttctgtgtaagaagaggtagctgtagaacctgtagtttggaaaggtgaacaaaccttggacacctaaccatgcaggggctgtgattcttgtcctgactccatcttatcagtttgggtcacctggggcctgtccttgctgctcctgcttgggactcagtgtcctcatgaatcaagcttgttcatctctaaggcatttccagtcctttcagtggatgagttcatgatattataaatttttttatacagtcacgaattgcttaataatagggatgcattctgagaaagggatctttaggtgattttgtcactgagcaaacatcatacagtgtacttacagaaacctagatagttccagcctactacacacctaggttatatagtgtagtctattgttcctaggctataaacctgtccagcatgttgctatattgaacaccgtaggcaactgtaacacaagggtaagtgtttgtgtatcaaaatatagaaaaagcataataaaaatacagtattataattttatgggaccaccgtcttctacggggtccgtcgttggctgaaacgttattatgtggtatgtgactctgcaactcatgagacattttacacatggagataaagacttgggtcaactctgtttgtctcagattgcatggctgcatagatgagtggttttaataagggacatttaagaagtcaatgattcgcttttagtactgactgacacttttatctcttttctgggaatcagtctaaatggcatgaatttggagtttgtaagagctgaaaagaataatgagaaatctagaaatggaataagccttggtaaaaggtgagaaacgattcaagcataaggtgaattactaaggctggttgcctacttttatgagctgcacagggaaaaggccacaaggtctgggaaatggaagaaaatgaaatgccaataaaacaaaggaggtgggcttccttgtaacgtacattcagtgagagatcataatgctcaacaaatctgttaaatcctcagacctctgcccagggactttttcactgcctgacctcacctgatctaaagttcatgcagcagcacagggagggagggtgagaggaatgctggggaggacttggatagtattcttactaggaagccataaaaatgcatatattctgggacagggtgtgtgctgtcatgcacagagccaccaaagtgtcatcaaatgagtagtgtccctatactacctagtgggagttgggtttgggtaagtgatgtcaatatacagccctcaggacaggaagaggaatgcttggcacaagacacaccattgagaagagttttgtaacaatcggttggaagagcgattgtggcattccttatagctccgctctggctaccctgctcctgcatatcacggccttaggagttacagacgcttgggatctctgagaagacacatagaagattcaggtatggactggctggcatgtaggcaacaggtaggacaaggtaggttgggggaatgcctgtgtaaagagagaatatagacaacccttcattcattcattcatttaaatgtatgcacacatccattcaatcaccaaatatttcctcacctggtaagggctaagaacctgccttcgggcctgaaatataatgcctttctcagataagtcttttatacccttctcccatttaaattagtcctccagttatttccttaatagcactttttatcacctgaaattacttgacttatttctttatatcttctctgtctcatccactagaacacaagactccttaagtcaggaaccatatctcttttgttcactgctgtagtcccagcactaaaatcaatgtccagcacatagtagggcctcagaaaaaccattttttgaaagaaaacatcatcacagagatgaatagaacctaggcccttcaagaaaagagtcaaagagagtgtgggaaagcacttagtggaacatagtaaaggaaagagaaaactagtacaaaaattgaattggttttcccctagagatttaaaaaagtacttgggattaaaagacaaataaaacattagaggagccatcagtgcattggttccttgtgctcaagatgagagggatgtgtagaattaattctcgagtactttccaggcctcctggcctgggagtctgctgtcttcaggtccgcaatgccagtactgtcacctgtgctatccctggactcaccatgttggggtggaagggacatttgacaggtgctccggaacccagcttgacattgacttctacccggctgtgtggctttgagacgagacagttgactttgggagcttcagcttttctctaccagtaaaatgagaatgacacttgtactaagtgccccgcctccacagttttgttttgaggttctaggtaatgtagtacgtgtgcttcataaactttgaaacaacatacagatgtttgcaaatgacaggtcaccaggatgctctcccctggtcactgcagggcaaggctttcatggtcttcttgccttcgctggggctagttacccacaaaatggagttctgatggtggactttaaaggaaaaacataagccattcagcgagcagctttgtttacagccatccattcaaaatcactaatgaagaattcattgaggtttccatgatgttttctttctttttaaagatgagatgactgggtctcaagaaatccttctttccctccaaagacattcatcgagcagctctatgcctggaactgtcttaataccagggaaacaaggtcggtaactgccatccttgacgtcatagctgcctcacggggaagacacagaacatttggcacactcatactcttataaggcaatgggatctgagcagtgaaaaagtgcatgggagatgtgggaacacccaagagagacactgaaattagcttggtcatgctggagggagggcctggaaaggccttctagaagctaagccctggcaaagggggtaaggaacatccacatagagagggaaacctgtgggagagaagaaagagcctggcccctctgggagccctgagctgttgttcagtgtggttgtcacttgggcagtgaggtagggagtggtaagagatgggcccagagagataacagggagcagatcatgaagcaattcattctaccttcagggtttaatctcatatactctaattttcaggcgagaatctaaaagttgctgtgccatttagtacagcagagcaggaagtatgtgtatttgacctccttgttaatttcttcccataggtacctttctgtaaaaagcaggctcatccccaaaacactgtgtttcaataagctcgatgcagtgcaacagtgaagtgactcctttcttagcagctgggttggaaatgcttctgtgtccctccagacctgctctctagcctcaccactctgcttggggcctggaggctgacagtgggaatagcatcaaggggctccctgccctctggctgcattaggatcagaagtcctaatgcacgcgaagttgggtatttattgccttggccccatccctaccaggccactctgggttggctgcatcccttttccaaaggtcatcctccttccagtgactctttttgggtaaagggtcagatctaagtaaagggtccttgtagttgttctcccatgtataggcctcaattatctcttgttggtgcctgatgtggtttggctgtgtacccacccaaatctcatcttgaattgtagctctcataattcccacctgtcatggcagggacccagtgggaggtaattgaatcatgggggtaggtctttcccgtgctagtaaataagtcttaggatatctgatagttttatagaggggagttcccctacacaagctctgtcttgcctgccacaatctaagacatgaccatgctcctcattcaccttccaccatgattgtgaggcctccccagccatgtggaactgtgagtcaattaaacctctttcctttataaattactcagtcttgggtatgtctttattagcagcatgagaacagactaacacagtgcctttaaccctgatcatgccctgagatcctgacacaccatcattgatttccccagcatcactggattctttggtgtaacaggaatgcagggtggtcagaatccttggtaccattgaataaagctacccagatggtgaggagcactaggttaggagtcaggaaacccagcttctactcccagcttggccaatgattagctgtgtgacctcaggcaggtaaaaatcctgccatgcattcattctgatgaaaggacattgtagcctaagaaggtagtgatgtctgcaaatggaaagggtagaattgtctgctccagctttttgtgagggtgccttaagggccactttggggtcaagaaggacacagccaggataagccagagaaggccttctttaaacttttttttctatagtgaggctccacacatgatttagttgacataacaaagaattccttgccaccaggaaacatttgaaaacaactgggctcaatgaagttatgaagtcctgtttggttttcagagctgagatttcctctgtgctcattcactgggtggagaccctggtaaggatacaatctcccctgcattccacaagtacagcagctagtagctaaaccacttgtggggtcacttaattgctttgattataaagaggcagtaaatgtgaccttgcccaacttaaaggagtcttgtgcagggacagaagaccctggggtcatattatttgtacacaattccaggatagcattaacctgagtcattttccatgaactactcacatgtatcagtggcagtgtgtctcacttgaaagtcagtgtgcctcttgtgttgcccatggaactggagacctgatactctttcactggcagccactggaagatgctgagaatagcaacatgagtggcactgtggacttaacccaagcatttgaccccattaacttagttggtatgtgggaagctctgcaaaatgtttgcttcctagagacacttattaacatcacttctcactctacaaaacctttcctgataattgtcctgccagaagttatggcccctccctctgaactcaacattcagcatgcttttctgctgccctttaaagttagattccagttggtgtgcacacctaagctctatctcttctgctaaactgtggtctccattggagaaagaaacatgttgtacacatgtctatattctctacagtgccttatagacagatgaaatccagaaagtgtttattgttttgttagctgacagtcagggttgacctgtgagggaactataagatagatttttgtatcgttgttataatcacaacaccaaagtcttagcctgttcagcctgccataacaaaatcctgtagattgtgtggcttaaataacaacaaaagaattatttttcacagttctggaagctgggaaatccaagatcaagatgccggctaatttgattgctgtgggggccttcttcctggtgtgcagatggctgccttccggctctgtcctcacttggtagacagagggagaaggagagggagagagagagagaatatctctcttcctcttgttataaatcccccaatcctattggattagggctacactcttatgacttcatttaaccttaattatttcctaaaagcactatctccagatacagtcacattgaggattaggatttcaacatatgaattggtgagcacaatttagtcaactgcattctgtccctggccccccaaagttcatggccttctcacatgcaatatgcatttattccaccccaacagccctaaaagtcttaactcattccagtgtcaattctaaagtctaaagtccaaagtcccatctaaatatcatctatatcaggtaagggtgaggcctgaggtgtgactcaacctgaggcaaaattccttcgcagctgtgaacctgtgaaatcagacacattacatgcttccaaaatgtaatgttgggataggcataggataaacattacaaaaaggagaaattggaaagaagagaggggtgatgggtcccaagcaagtccaaaacctagcaaggcaaattttattagatcttaaggtctgagaatagtcctttttagtttgatatcccaccttcttagcctgctggggtggcagttctgcccccatgactctgccaagtcaggttttcaattgattaagtctcagccacgttagggagggcaatctattttttctcagtccactaattcaaatgttaagctcacagatacactcaggataatgtttgatcaactatctgggcctcctatggcccagtcaagttgacatgaattaaccatcacaaggggctttaggaatcatctgatccagccatctctccaaagcatgaatccctgtggctacttgccattaaaaaacctgaggagattcatgccacgcttaactattatccttgttttagcagggttctattaaattgccttcaaaggttaagtttagattaaaattagaaagagtatgaaatcacagcataagcattttgagaacaaaggctgctgctgacttctcaagttcctcccttgcgctttgtggtgctggcccagccaatagtgtgagcacaggagggcagatcctttccaggtcaagacaaatggggtttctgccagactccgacctctggcaggctcagtgcagctgcagccactggcagagggggaatgacctggggagaaagctaaaggccagtctcagtctatgaggcttgggttctgaatacagagggtcagtacctagggtccaaggctctccccttcccaggtagcagcatgactcttctgcccccatggctagaactgctctgtagcctggaagtgctgatgtgcaggattctgtctgcctttctaggctgcatttgacatccatttgaatcttgtttcactcttgtcaaaatgttgggaggaggaagagacacacaacaggattgactctgacattaagtactctccccacccccaccgatgctttccaggtggtgttttaggagaacattgtctcctttcctgattgtcatcactaagacctgagacacccttttccagcttctctgacaattagcctcagcatcctgtggaagctgtagagctctataaatattctcattcctgatattatctctgtaaaaaaggtgatatcattttggctaggaaaagtcagaattgctttgaaattttggtaaaaacattaagaaaaatccccaaattgaaatgtagatcaatggaagtagttttctagattcaccagttttctatggtgataatattactgtttgaccagtatctccagtgctgcccttacaacatcgtactcatgacgttaataagcacgtaagtcaggtaatatagtttaatttgaatggtcaagtgagaaaggcccaccttgctctttatagcaatctctgcagtggttctgttttgtaaatagggaatattaaaatttaccagaagttagctggggcaaggtaggcatcccattaaagataccaaaattccccaatgggcagagttgcagggaaaataatatctgccctttagaataggaggcaatagtgaaaaccccacccctgggctagcaatttgaggaacttcaccatcaggacattgatggctaaactctgggtctaactcctgggtgtttctgtgtatctatgatgggattcatctcacatccatgcactctctccagcgacgtctccatccatatatgcatctttgttcttgagagggaagtgtagaataggagcttggaagtgaatccctatgcacaagaccctgcttttcctctgaaccaggcaaccttggggaagacatggagtttctccctgaaactcttctcctcatctggaaagttgggtcatgtgaacagggttgttaggacaattaaattatataattattcaaatattctttttaggctactgtgtgttttacaaatgaaaggtattgttaagatcaaacaaaacaaggtagactttttgcactcatctgaatgcttcaccctctgattcactgtaggcagcaccaatgccctattactttttaaagtggtttccattcatgtttaagtcactagtttccattccagcaataggtcagtgagttaggggcagctaaaaatataactgcctgaacgaaacaaagaatcctccatcttgacttttactctttgtttcctttttgttttagaaaaccacttgagttggccaacaagcacccaagtgtgatagaaggatggtgggtttcacatctcactcccatcaaccataaatgtgtagcatcacacaagctctctgagcctgcctgcaggtgagttacctcacagcaaaaatttaaataataacattcacactgcagtttcttctgaaaacccctgttacatagtaagggtgttcatcctgccttacaaaatatactgatgccaagtccaagatcagaaatgtgctcttaatctaaatttaggaagattaaacaaagttggtgagcatccagaaaggtcaaaataaaacttgagtttgcaatataatgataaccttggagtatttcagactgtcagctcccttaagtggcacacaggttgttgtttgattggtgtgatgtcagacaaacctggattcaagaccgggttcttctcctaccagctctgtgatcttggaaaagggactggatctctgaaactcaggttcctttcatgtgaaatagacccatatcaagtctctcctcaagctgtccatgtgaggattagatgaagcatctggctactgttattattgtggaggaacattagctcaagccacctgcagcagacagaccctaaagtgacccccagatccccttgccttctggcattcatgccttatatataatcccttcgagtgtgaatgggatctatggcttgtttctagctaacagaacatagtaaaggaaagattttctgcagatgttatcaaggcctaaatcagttgcttttgaattaagcaaaagagatgctatcctgggtggccttactgggtgaaagctgctagaaaagagattcttgctagtcctaaaaaagcaagctactatcatgtgaatttcctgtgaagagggccagttggcactgtaccataggcagcctctaggggctgagggcctcaatcctaaaactgcaagaaactgaattctaccaacacccaccagagcttggaagaagactcagaactacagacaaggatgcagtcctagctgacaccttgactgtagcctgtgagatacagagcagaggacccagctaagccattgtcagattcctgacacgtagaaactgtgagataagaaaggtatttgttttaaactgctaaatttgtggtaagttgttacacagcaaagcaaactaatatacccctatttctggaaatcatttcctagagacaggcttgtattggaggaagatggggtttcctcacgtcccatctacagaactgatgaatgtagggatgagggaaggaaaagaaagcttcctcagatacatctgggagtgggtatgtgtgagcagagggttgctatagtagaaagagaggttaatgagacagaatgtgaggagctcaacactgatacttgacagccttgtcaaacacagctattggttgaaactgtgtgaatccataacaagatttttaaaaaattagactttaattgttatgttgtggatttgtgcataccatctacttcctaaaagactttaggggcactcgaaatcaaaacaacttatgatcatagcaaaaataattaacaagaggaaagatgggcatcagaataaggttgataaagggcagcgatggaagagaaagttgtatcaagagttccagaggctgtgaggcaagccccttccccactctcaggccattctaacctaccatcttcaatggtatcaggtgctcacacctataaagcccacctctaaatctgactctgccttggggaccttgtcctgcattcctgcacatcctgtgggatacactgtgatgccccacacgtaggagatgctcagcagatgtctagtgaaatgaattgttgacccagctcatttctaacaggcagcctttccagagaatgacagcgaatgtgtactctctgtgtttgaagactgtgtgatgttaattgaagtgcctgcaagtcaaaataagaatgacagtttattttaaaaaaatattttaatggggatcctgaaagtgaaaacaaatccttcacggagagattctttattgaagagaattttagaaagaccacagaattcagtcctgccccactgtgaattcaattccctgggtaaactacatagcgtgtgtttatgcctaacagatacatatgcatcatatgcatgggtggcctgtatgtgaatgcagaaatacctgtgtatttacactccagtatatctgctgtaagtctgtatcagtgtttctccaccctattttcattatcacctccctcaaggacgctttgtaaacatgttttccctaatcaccccttatatagacttaataccacagatacactgtatatctatttaagggctgtatgtatatatttatgccttatataaaaagagtgtaattttgtaccccatatgaaccaattttattacttttggggtgataattacccccctgccttgagaatacatggtctatatgtgcatctgtgtgtgtgtgcatatgtgtgcctgtgtgtgcacacacacacagacacacaaacacaagctaactgggcagaggtctgaaaagcattttgagatatttgaggagaggtttcccatcaataaccaagaaagcagttctggtccagtgattcttgtaggaaacagatgctagcaattagaaaactggaaaactccagttggtcctgaagcacactgggcatgacctgttttccaaatcttcagagatgggggagattttataaggccatatgagcagaaaacatctaattgttcataagaggaaaatttctgaaattctaatgtctacattgccattgcaaactatgaagttctcacatctattttaaagtaactgagcaaaatacattttggacaaaagggaaccattagcatgtttaatattttataaatatgatcactatggtaggcaagactttattcaacaatcaatcaagctctgaaactctcatttgcacctcgaaatgcttagctttacaaaaagagttgtaggaaatgtggaagtaaagatcaatgcatctgctttcaaatatcttcaatccaattttgttacaacataaaccagataaatatctgaggacctcaaatctgtgtgagttacatcaaccacaggacatgggagagaaaacccctctcttgctactctgagtaactgtagcactacaaaaacacagcatcattcaatcacatttctaaccctgacaaactttcacataacagaggtactgaccactttcacctttcctttttaaataaaactgtaaactaaggagaaggtaaaaacaagggccactagagtgggaacagatttgctaacaactgtgattggttagtgtacacttactatgtgcccagtactatgtgttgggcccaaatacacgaattctttctatagcaagccctgcggaaatcattcagcctctgttaaaatacatccgttcatgggaagctcaccacctttctcaagataccccattgctctgttggggaagttttattttaagaaagttctttgatgtgttaagctaaagttggcttctccacttaaaatcttaaaatcagccctcagcttttttcttgagattgacataaataagttgaattatttctccatgtggttcactaaaggcagggctcatggtcagcagatatccccaccaagaccacatcttcagtgaaggctgaccagatgggaattcaacaggctgagggtaaggataacagttaactgtcttacatgttgttgctcaggtagtgaatgacatgagtattaaattgggcatttatttacccgttgatgatagactggataaagaaaatgtggtacatatacaccatggaatactatgcagtcataaaaatgaatgagatcatgtcttttgcagggacatggatgaagctggaagccattgtcctcagcaaactaacacgggaacagaaaaccaaacaccgcatgttctcactcataagtgggagttaaacaacgaaaacacatggacacagggaggggaacaacgcacaccagggcatgttgcagggtgaggggtgaggggagggaattcagaggatgggtcaatagttgcagcaaaccaccatggcacatgtatacctatggaacaaacctgcacgttctgcacgtgtatcccgggacttaaagtaaaaaataaaaataaaaataaaaaattgggcatgtattacccaacaccatgtctcatgagtggtgaaagaagcagataaatctgggcaagtaaaggaagtccactgtgtacagtgcccacggacctacagagacagagggtgcccagtgcctacacctttgacctccctccaaccactgctgaagcttccttgacacttcctatccttgacagttggttacaattatgtctgctcttgccctcacccattcactctctcaccagaaaataattaaagggaactaatatatttataaataacagtccttttcctttttaaattttcatataaacttgggaaatgtacagtgaacaagtactattggtatattctcaatattcaagcctattatagtgtccaggaaaagggatgggaagaaagaattaaagaaagaaatgttttttttaaaaaaaacctcaaggtggccaggaacactgttccttcaccccagataccaggcaggcccctttggccactccttaggagagatgataggttaggaacatgtataagctgtgtggccttgaacaagccacttaaccattagtgcctcagtttcctcatctatacaatcctaataatagtatttaatacatagagttgtggggattaaataataaattcacataaagctattagagcacacatagtaagcatttagtcaatgttagctgtcattactattattcttttcccttgaaggaggctttcagaaatttttataacttgatttcactcagtgagaagccttcaatttggtaacagaagaggggatggagagggaggagaaagaactcacagtgtgatctgctttacgcaggcctcccaaggctggcccagcaactcaagataattctgtgttcatacaagccctacctacaatactgggttgacatttctgttttctctattaaaagcatcccaaataatgtactgaagttgtaaaataaatctttggtgctaaatatcctaatgagacatttagaagcactcaaattaggtgttacaattaatatcataggatctataagattcaaaagaaaattccatttattttttttctaaagagataataatctgagactggataaagaaatgtggtacacatacaccatggaatactatgcagccataaaaaggaatgagaccatgtcctttgcggggacatggaagctcaaagccattatcctcagcaagctaacacagaaacagaagaccaaatgccatatgttctcacgtataagtgggagctgaataatgagaacacatggacacaggaagtggaacaacacacacacactggggactgttgagggctggggtggggggagagagagcattaggaaaaatagctaatgcatgctgggcttcatacccaggtaatgggttgataggtgcagcaaaccaccatggcacatgtttacctatgtaacaaacctgcacatcctgcacatgtacctcagaactaaaaaaaaaaaaaaaatagaaatgaaagaaataatgatctgggctcttttttgcaaaccacggaactcactctagctaaattaagcaaaagagaagtggggttagaaagccagttcttgatattagccctttgtcagatgagtaggttgcaaaaattttctcccattttgtaggttgcctgttcactctgatggtagtttcttttgctgtgcagaagctctttagtttaattagatcccatttgtcaattttgtcttttgttgccattgcttttggtgttttagacatgaagtccttgcccatgcctatgtcctgaatggtattgcctaggttttcttctagggtttttatggttttaggtctaaagtttaagtctttaatccatcttgaattgatttttgtataaggtgtagggaagggatccagtttcagctttctacatatggctagccagttttcccagcaccatttattaaatagggaatcctttccccattgcttgttttaatctacaatgaactcaaacaaatttacaggaaaaaaacaaacaaccccatcaaaaagtgggcgaaggatatgaacagacacttctcaaaagaagacatttatgcagccaaaagacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacattgttggtgggactgtaaactagttcaaccattgtggaagtcagtgtggtgattcctcagggatctagaactagaaataccatttgacccagccatcccattactgggtatatacccaaaagactataaatcatgctgctataaagacacatgcacacatatgtttattgcagcattattcacaatagcaaagacttggaaccaagccaaatgtccaacaatgatagactggattaagaaaatgtggcacatatacaccatggaatactatgcagccataaaaaatgatgagttcatgtcctttgtagggacatggatgaaactggaaatcatcattctcagtaaactctcgcaagaacaaaaaaccaaacaccgcatattctcactcataggtgggaattgaacaatgagatcacatggacacaggaaggggaacatcacactctggggactgttgtggggtggggggaggggggagggatagcattgggagatatacctaatgctagatgatgagttagtgggtgcagcgcaccagcatggcacatgtatacatatgtaactaacctacacaatgtgcacatgtaccctaaaacttaaagtataataataaaagaaaaaaaaaaaaaaagaaagccagttcttggcttctgccttgaagatgctgggcctaagaagcgtgttcaaatggcactgggtagcaatgaagtaggacgaatatctactacatacatcaataacaaaatcagttaaaaatactcccaaaatacaaacatatgaatagtgggcaaaagtgccctttattgttacttgttggcaaaagaaagaaccaatttcctgccagatcatggcatttgagactatggaaaaaggcctggaacatgaggaaattaggcatgcacacacacacaatgaaagtggctaatgtgaaagttaaccaaagtaagttaaccaaagccagagactataagtaggttccatgagtttatacaatctgaattaagcccaggacccagcaggcccaggaatgtggttccatctgtttcatggttgaaaaattccccagagaggccaagtgccttgatcaagggtgtaggggagtcaagagcagaaactgccctgagtgtttaccattaggaatgtgtgacctcataagacagtattctcctttctcaggtaatctgtccttgggagcggttgtctggggcttcacagaatggctttcctgcttgaatggcttggctaactcacctggtatgcaaaattggtttggaaatgagctaatcattatatttttcacacggtgacatcctggaaagacctgctgtgagttcccactagggaagtggaaacttcctagctaccttctcataggcaggtggctatgtcccagcacacagatgttaggacactgctcagaggagcagcatgtgtcagcagcacatggcttggcaggagccaggagtctaagcagtaaatatcaagggaatgatttgtcagaatagcaccccaagtgcaggggaagtgagaggaggcgtagtggtagaattagggaatgagttctgtctacatccagggcttccacctgaggactcgagtccgcaaccacaaaaacctttctatggacctggcaacaaagtcctaagcttcagcccctgtgaatatttcaacacatgcaggataggaatattaataacctggattcacatcagaatgttctccaagtaattcagaatgcttcattttacagctcaaccctgaggttgccagatctcagtgcttcatggaatggacagtgacaggtgaatatggccactctcactgaaggcagctcctccaacctcataaccatttacagcaaaggccaagcccacagctccaggcatcatgccacattcgttcaattccttcttggaagggtacctaggtcagcgatcagctcacacctgtttttgtagatgaggtgttactagaacacaggtatgtccatttgtttacatgttgtctacagctgcttttatactacaaaggcataactgggtagctgcaacagagactgtatagcctttaaggtctaagacattcaccctgtgactctttacagaggacatttgctgacctcaacctaggctatgagagctccaaggccattcaccaagtatattgtaaactccctgagagcagagtccttttggaacctcccatgggacctcacacagtgaggtacacaagagaatcaaagaatcaacttttagagctgaaagggacctcgggtatcattttatccaacccttttattttagagatgaagaaacccaagctgccagttgaaaataacagaatggcagaaagcagaaccaaaaatcaagtttcctaaactccactgtaatgctctattacttgacaattggtgaatataaaataaatgaaaagataggtatggatttacacaggaatatcatttgctgggtatatggtgtgtgccaaatactatgtggatgtgggtatttcagttttggacctcaaatctcaggagaaaagtgtatgtatacatattatatatacacataaaatttatatgtgtatcctgtatattatgtgtgtgtatacagttgacccttgcaaaacacaagtttgaactgcacagatccacttatacatggataagtataagtgggtcttccacctctgtcactcccgagagaataaggccaacccctcctcttcctcctcctcttcctcctcagcctactcaatgtgaagatgaggaggatgaagacttatgatgacccactcccacttaatgaatagtaaatctattttctcttccttgtggttttttttttttttttttttttttgagacggagtctcgctctgtcgcccaggcaggactgcggactgcagtggcgcaatctcggctcactgcaagctccgcttcccgggttcacgccattctcctgcctcagcctcccgagtagctgggactacaggcgcccgccaccgcgcccggctaatttttttttttgtatttttagtagagacggggtttcaccttgttagccaggatggtctcgatctcctgacctcatgatccacccgcctcggcctcccaaagtgctgggattacaggcgtgagccaccgcgcccggccttccttgtggttttttaaataacattttctgttatctccttactgtattgtaataataccatatataatgcatatagcctacaaaatgtgtgttgactgttatgttatcagtaaggcttcccatcagtagtaggctattagtagttaagattttaggaagtcaaaagttacacatggattttcaacttgtatggaggggtcagtgcccctaacctccacgttgtttggaggttaactgtatatatgtaaaacacacacatactgtgtatgtctgtgtaataataagatgatggtgcacatgctcctttgaaggagacacccaccgtgaggggagtatccatctgatttgtgacttcagggtcaccatttttagttgttaccacctgttcatctgaacccaggtgatggaagtcagcaccaaaccgaaggagcagagccatgcatggatggtctttgtctttcatccctggtgtattggtttgttttcatgctgctatgaagaaatacccaagactgggtaatttataaagaaaagaggtttaattgactcacggttccgcagggctggggagacctcaggaaacttacaatcatggtagaatgcacctcttcacagggcagcaggagagagaatgactgccagcaggggaaatgccagacacttatgaaaccatcagactcgtagactcactcactatcacgagaacagcatgggggaaacaacccccaagattcaattacctcccatcgggtctctcccttgacacatggggattattacaattcaaggtgagatttgggtggggatgcagagccaaaccatatcacagagcctctttttccagctcttcattgaccatcccccatgtcacaaacctcttgtcaactaggtgcatctgataaccactctttgaaatgaagtctgggtattccttcactctacagtgttcaccaacaaggcattccctttgagaggcatttttctcccactctggaatgaaagttgcctcgccctagttagagcaattcttggcatacagatggaaaatgctttctgaggagtgttaggcctagataagcctcttatcatcctttagggtgaccttaactgggagaggaaccagaagagatagtccatggtttttctccagcagtgtccttactctcctggggtaggtgggtaccaagagaaggtcctggggtcttgactgggtggagagcctggtgtccccctatcacctgctctggaatctgccctagcaacaggtctacgggggagagaggggaagaggtggatggctttctcccccttctctgcctgagcttagctgggcctctcccctcatgttgcacacttgaactgaaccccaacttcttccctggctgtgctgcaaaacactgcttagtgccttcctgataccaggtcccttggcttggagctcccatagcctcattcttgccttcaggccacagtccttccaaatgcccagtggctgccactctcccagacccccaggctgcaagttctgccaggtcccagctggcttcccccacaagacccagggcctggcacctggtaggcttcagtaaacagctgccacatggaaaagtgcatttcaagtaccttgacttcattttttattgtttttaattatgaacacacattaaagggttttggagttagtcagaaaccccaactctgccactttccatgggaccttgagcaaaacacctaacctttctgaagccagatttcgcatgtaaaacaatcacaatatatctaaaggagtagggatactggattaaacagagtgtcaccacaatatctggtgcataggagagagatgctctgcaaattatatttattataatgccttccctgatcctgctacccttgaccatggcaagtgtctcagaaagactcagaaagtcctagcagtgaggctggaccacccccaccccccacaccagggagtaaactcaatcagcagcagctttattctcacctctgctttcagtcttctatgtggcattataacagcctaacttgtctgggcctcaaggaggaatgaagctgctagaatcctgcgaggactcgatggaatccatcaaattccatggacgatattgtaaatttctttagatttattgttatatctcacatttatagtgcctagtgaatagtctgtaattttttttgttgttgttgttgttggactctgccatacatatctgtaaatgactctaggtcttagaatggaagaagagccgactggaatagatgtaagatttctctcaagtcagtggcttcatccttgcaaagatgattttcagagcttactctagaatcctgactgaggaacttgggccaatgccacatcttgggcaaactggccaggggacaaaatctgctcttggtggccacacccacaatgcacaacaggtacacttttttttcccagtggcatgcaatactcctggtctctcttacccacttccttctggtcctcttccctctgcctactgacctgataaagtaatcccagataatgtgtcagctggggctactgcatccataggtagcccattacaagtagcatatgtatatttttaaaaggacgtctaagaaacattccttaagccaaaggggttgatcaaagaatgggagttcatgtcactatggcagagaagtgggtaggagacttgagaacaggtgcgtctttaggctgctctaactcacccaatctggtaattgccctgctttcttgtctaagtgttgggatctgaccttgaccttggactattcattgccacctatggagaattaaggaaaggcaaaaccttggtcatctccctcttgctcgccattgggaaaatgccttctgatttagcgcagcaatttctcctcattaagctacaaggggctgggtaaaatgaggcaggagagagcacaaattctgatgtcaggggatgaagtttgaagccaggctctacaatgtcctagctttgtgcatttatccagatgggactcagtctgaccttcagtttcctcatctgtaaattgggaatagtaccaagacctactccatggaattcaaggaatcagcgaaactaaggtgttcagaatagcagttagccactgttgctattattcaatttccaaactgattctctgattttgaaaatgcaaagacaccactcatgggaccaaagaggactgaggtgtgaagactggtttttctgtatcataagccacttcagtgatcctctgtctcacctacccttttccctcttccatccccgctatctctttcccaacattttcctcttcaagaaccttatactttgaggatggggataaatacctttgcaaaaacaacaacaacaccaacaacaaaacaataaacaaggctgcaactgtttttataattccacgggccatggagcagatcctaagtctaaaggtcactatataaaatgactgagatgttatataccttggggtgacctgagagcagtagaagaccactcgcctaccaaatctctcctacatttgaatgtcacagggctttaaatttccactgttagactcacccctgtgggttttggatactcccatggggcctggttaggttaagggcagtgttcccttaaccagactgggcacaagaatcacctgcagcacttgttaaattacaggtatctgggacctccttccctgaagactctgattcacacatttgggctggagtttggaaaatgccccaggtggttctcatgcctgtgcaaggctgggaaaccctgttctggtggagagtggtcaggtctggagtccggatctccaggtttctaagtttgtatagagcaacccatcatgcagcccctgacaaatcacctggtatatgagaggattaactatcttccttcctcaaaggataagagacccaaaaatgcttcaaaaaactgtatgtacacacaaggaaccattttaacagaatatgggaaataacgctgggaaaaggaatgcaagaatagtttcagtatcaggtggaagcagttgaagttgatctagcagatggggaatcgatgtcatacaggagaaggttcttctttaggaagattaagtggacagtattaagcatggtcaacaggaggtgagagaggctgcaggtgggatgccagtttgtagtaggaaacaagaatacataacttagtttctacggtagagactagctccaaacctgcttcctctctgtccttgcagcacagttagatgacacttcccagcttcccttgcacagaggaacagccacaggattgagctctggactatggaaagtgggtggaagtgattcgaccatgcaaacctaccatgatgtcctccaacttcaatcttccctgtgctggctgactgtagagagcccagcaaaggagttggccgtcccgcagggtggcagaactacagggtggagggagtccaagtgggggagaccactcactaaacactgcattgagctactgtgtgaaaaagttggtaggttgttgtttcagcagttgacctataccgaccaaggcagtgcctgacatctgaacagtgaagactgtagtttgcaaaaggggttcatgtttcttatcttatttgacttcataataataatcctgccacacagatcagatccctgttatattcacaaagtacctgaatgaggaaaggccacataactttccctacacagctcccctctcccagagcctgtggggaagccctgcccagaaccttcaattccacaagtaaaacctgagtcatttgtgacaaagggccaaggacatatggctcctttggtttcaggggcaaattctaaagacactgctgtctctagattttatgctataactataaaatgccacagagagcaaatgtgtaaatgaataaaaggcaggtgagacggcccctcgtcttcatccttggtgttgacggggcccatgcacactggcagcattaggaagcagacgtggacattgacaggagaggagccttgggctggatcaagaaacctctatctgttgccatgacaatctcccaaattggatgtttaagagaataactgggacatggtgttacttcgtctctattctaggtaatgggttcccagttggactccattcactgcacatcctcccctccttccccttttgtgttatttctccagtcggacacttgtttcttttccctcttaccatagaataacgttaaacaaaagtggaaaagaaaccatcaccctgaagtccatagaggttgatataggatatggggtaactggcacaaaacttctacacaccaaagcctgtgggtaaccagagacgtgctgcaaaggcctcccacgccaaaacaccctgcctcagatgcagggccaaatgcaccatgtttagataattaagcacttccctcttttaaactacaattgctccacaggcaggtaggggcacagcagtcttccactttataaacaaaagtctggatcccccagcttgccatcagagatgcttcatgatctgatctgctagatctgaatgtttgtgtccccccagaattcctatgctaaaatttcatctctgaggtgttggcattagcaggtggaggctttgggaggtgattaggtcatgagggtggagccctcacaaatgggattagtgttctcatgaggggctgaagagaatagagttatcctcctccacaatgtgagaacccagtgagaaggtgacagctatgaaccacattgtggccctcaccagacaccaaatctattggtgcactgatagactccccagcctccagaactgtgagaaataaatttctgttgtttataagctacctagttcatggcattttgtcatagcagctcaaagagattaggacagagcctatgtgtgtatatatatatatatatatttatatatatatatatacacacatgtataaatatatatacatgtataaatatatatatacatgtataaatatatatatacacatgtataaatacatatatatatatatatatacacatgtataaatacatatatatatatatatatatatatatatatatatttagatggaatcttgccctatcgcccagcctggagtgcaatggcgcaatcttggcccactgcagcctccgcctccttggttcaagcaattctcctgcctcaacttcctgagtagctgggattacaggcatgcgccaccatgtccagctaattttttgtatctttagtagagacggggtttcaccatattggccaggctggtctcgaactcttgacctcatgatctgcccacctcagcctcccaaagtgctgggattacagatgtgagccactgcgcctggcccctaacttacatttttatctgccttcccaatatccattcacaccctcttcagcacagccaagcagagctctgagttttctgggacacatccgggcttgtcttgcttctgagccattgttcacatgatttcctttgcctaggacattgcatttatttcctacctcttattccttgatcaccttggctaactcctcacgtgcctcattcctccctctcaaatgatatttcttttttttcctttttttttttttttgagacagtcttgctctgtcaccaggctggagtacagtggtgcaaactcagccctctgcaacatccacctcccgggttcaagcgattcccctgcctcagtctcctaagtagctggggctataggtgggtgccaccacacccggctaatttttttgtattttgctagagacggcgtttcaccatgttggccaggatggtctcgatcccctgacatgatccccctgcctcggcctcccaaagtgctgagattacagtcatgagccaccatgcccagccccaaaagacattttttaaagcaagtccttatttctgtacttcttctccatgctccctcctctggggaacctcctccgtcacctgtagctctgagcagaagttcagataaaatccctagccctgagcccctgtgatcctcagctctgatccttcagcattctaaggaacatctgcacaggactggcctgccagcacttcagattacaccattccaaatcaaacgattttaatgaacagcaactcccttcctcacaggatacataggctttcttcagagttaaaaggaaacttaaagctcaattagtttgtctgtactcttcaatttacaatatcttagacagtaatggtcaagcccatcaaagatatcaccattctagatgtggacactaacctttccaggggtgaatgtaccaggaaactgctgagtcttcggtgttggtgcccctaatatacactatttgcacaggcttcttccaaggcatgcacctaattttgtattcacttctgtattccacaacacactctgtcttttggcccttgtttggactcacttggcctcctgatgggaccactgggatagcctcctcactgacttctgcctcagggctctccttattccaacatggtcacagtgaatgcagccgtaatagcaatggcaaaaacagcagcagctcacattttatctcactactcttccttaaacccacatagcgtatatcccaaagtgttagattgggaacttatctcatcagagaaggtcagactggatgacttctggaagcttttccaaataataaattctatggttttatgaatgttgatcacattttatagaaaaaaaaaacttacccttaaagcaagtcacgcaaccagtgcgtggcagacctggaatccagatcttctttcttttgtttgtttgttttttcctgttttttttctttttctttttttttttttcccgattttcatttgcacaaatttatggggtacatgagcaattttgttacatgcatagattgtgcagtgatcaagtcaggacttttagggtatccatcatactttgagttcattgattttcccactaaagcacgaagtccagctatcaatctttctaaacataacccaagtcaatctcctattgtgtgtagacacttccagttactccccactacttacaagggagcagataccacttacctcccattcaaggccccctcctgccactgttgttggcttttttgctgtcctatttccaattgctcctttcatataccacttgcttcagacaaccccgtgtactcataagccctgagcatccccatctccacacctttgctggacctgacatggttgctcacttttggccacctctgaatcctgatcattcttcaagactcaactcaggtcccaccctacccaaagctgggcctgaagacaccatttgggccacactggtcccatcatatgcatgactcattgcattcctgtcactcatgtgccactgatgcttgtttgcattgcactcctcagtggcactctcacaagctactggagcctgtcttcttctctgatctcccccagcccccttcagctttcacagagcctggcacagagtaggtgctctgtaagcattttcatatattgattgattgattatattttatccccaactccctacattctttatcttactatctccttcatgcattgccatttaaaattatgtgtcactcctatataataaaaaatatacaaaggaagaaaagaaaaattacaaaagaaaggtcaaaagcatttctttcctcccttttctggtttatttgaggtcaatctggagtgattcatgtgaaccagcatattgccttggctacctccatcctgtgaaatgcttgtttgaagtagcgactggaccatattttgtccttttgatgctccactgagtagttcagccctatttacccatggtttgcaccagtggttctcagtctttgatgggcttcagaatcaccagtgggtagcttcttaagcatacagatgcctgggcctcaccccaccctcctaaatctgaaactctatagacaggacctgggcaggtacaagtgaagaaggcaagtgcagtgactctttcatgccccaaaggctgagaaccaccagcctacccatggtttacctccagtgctgctggcatgggaagagtctttgaatcccccttaaagactcttcccatgccagcagagctaaaagaacttctagaagttaacaactccatttctttttacagggaagaattcgtttcagttcagacagtaggctatttatcttatttgtccttaaagaatttcacatctcagaacttagatacttctttcttgaaagaaaagacacgtttccaaagcaggttgtcatttagcgaactggaagagaaatgtccctgactgtgggagctgacccctcagaacacaagcagtgttagatttaagacaccctgggtagagagagtcctttacagaactacatcttaggaaactcatgcttaaccactttgcatctttactatctctagttcctccagtcttgacaacagatacaactcaggatgtgttctgggtaatagttttttaatagataccagagagtgagagcctacgacattttccccataatcctggtagataatacgtgtgcatgtgtgagtatatttgatgagagcacctatggctatgcatagctggaagattgttgaggaaggggtagtaaaatctgcaaagagaaccagggatcctcttgaaaataaagaggatcctttaccctggcctggctaccaggagccttggggaagcagttatgtaggagctttcttggatgagggagcaactgacaggaggaatcaacttcccctgagtttgaagaacccagtgggtcagggatctgcagttaccctgtagtcagtccaaccacattactccagacatgggctctagtgggctccagcttatggagcagcagtccagtcagaggcagtcagatccagtggtggttgcactgtacttcagttgccattggtctgcagcaatgagactcactgcttgtgttctcaggggtcagctccaacaatcgggaacatttctcttccagttccctgaatgacgacctgctttggaaacttacattttctttcaagaagtatcttggttctgagatgtgagattcagctggtaggactgagcctctgacttcttgtacacatcaagggagggaagcccaagggctttacttttacttattgggctacatggagcctacagagaaagacttactaataggccagatccatactcagcttgaaatgctgacaccaactccatgaaagatgtgctgctgctattagcactgcactggttaaaacaaaaaaaaaatctgtggtccagagaggtcaagcagcccatcctggccaacacactggtgaacccgagcctgacaccaaagtttcactcttccaccacatctcttgccaccactaacatggggccagcagctgacaactcaaagggaaccaagaatgagaagtttttgacctaactgactgtctaaattgacagacgctttgtcttgcatggagggggccaataaatgcccaaagagacaacacaagtcatcagggatgcaggagctctcaacactggcagtggacgtcagcttctgcagacccagtcctcattcccaccaccctgccatggcacttcaaatatgcatcatacaactcttgacgctagctctccagggatgtgttaccaggagaagaagcactcactgccatagcagggcaggcaaatttgtgtattgcgttattgactacagatcaaaacctgaagatagtgggaaagaaaaacacagtagcttaatatgatgaagggaactttaaaaacctagtgagctcatgcttaggcaagcggcccaaggtgaccaggcagtcacagtagctcagggacatagaggcgacaccacaagatctgatcctatctgttctggaagtcagatgaccacaccacgagtcaccacaacttgtattgcaccctgcaccactcagaaacttttgggccactcaataaatgaaagactagtcgtttccatcagacaattagcagaactctgttttacttcccccatgctgaattgatgattctttgactagaccaaccctatacacgattgttctggagtcctgtggatagggcttaatagttcgtcagcatctgttaactgggcagtgattggatgcaagctttctatcaacaacacttctgaccgtgatgccctgaggctgttagaagttctggacatttaatcagcattagcaaggccacctatgtcagcggtggcagaagctgcctgctattggacctgcctctgattatgactcagtggctctccaccagggctgcacgctggagccacctgagagtggatatgaaaatattgtttcagggtcccacccacagacacactgatgtaatcggcttggggagcaaactgccatcagaagttttaaaatctctctcaatggattgaataggtagtgaaggctgagaaccactggtttctgttgaaacctcagttcctggctgaagagacacttgcggcgagcttgtctgtatcattagtcacttctggggtccaggggtgagactgggagtggaggaagcaatgcaaatgggtggaatgccttgatctaacctacacagcacatcctgtgtttgtcttttcaaattgctttctgttttgcttttacttccttgctctatttctttcaataaaccacactcactgccattacctctagcctgttgtcctcctcttaggatcaaagtccaagctacatattatctcatttactctcaaaatatccctgcaagtgaggaaggagccaggcctttgttccccaaggcaaatcagggacgtgcaggtccagaaaggttcagtctgccatgggactcataatattcaagtcagtgtgtttacagcaattttcaatttacaaagtgttttcacctatgttctcccatggaatcctcacagcaaatctacaatgacagtattttcataaccagaatgaccacacatccttatttgctcccaaactatcctgggttatacctgtggttccagcctaattattgatatcattccctttcactctcaaaagtgtctagatttggacaataaattatatggtctccttatttataaccatgctcttgttttaagagggccagtgaggctcctgaaagttaaataatttgttcaggatcatttagctaattagaggcagaggcaagacttgaactcaggtactgcatctccaaatccctgcgccatccacaggtattatgggacattagaatcagagttgacatgatctaacatttcttattgtagaaactaaaaatgtggggaaataatctcttaaaagtcactgtcagaatgttccccgaaagggaaagactcggagtacatagcagaaatgggttagtctccttggaagcattctatgaacacattagaatggattaataacataaataaatgtcaccatgatggcacttgaaagcctaacttggcaaaataaggtatcaggcctgacatataggtatttggaaaagagcaagaaattcaaagtctaaactgctagatttgaggactggatctgaatgctatctgccatctacctttgggcattttacctactttctgtgagcacatgtattgttcaacagaacaggaggaattatcattcttagttccctgggctgttacaagaagagcaaactgcagctcatcaagtgctctgacagcgagtctcataaggtacctgtgaatccagtttatttgttttctttatctttcacataagtgaatcaagccttataaagttgctgatgatcaaatgagataaggtatttgaacatacttattatgtcctaatatgctgcaatctttccttcttcttatcattatcattatcagcagtagtagtaacagataatgactatcaattgacgtgggagacaattacaattacatgtcattgtgaaactcattaggtgactgtgatttagagtggtacacccagtggaaacaagaggttgggaggtccttccaagggggtgttgaaaatgaccaagtcatgactataactgggtgggacccatccttcttggaagtcttcatagaaaccaacccaccctgccctgcagaaagagcttcagttacctgacaccatcaacaagaaggcctttctttttatggggaatcatgtacctcagagaaactccaaactttggaaaagtgtgattctgtcaacaaggatattgcttccctcaaatgacacagttcaagtaaggcctgggcagcatctttatttcacaatatttctagcctttacttgtcccatttacttgtaaatgagaactgctaacctgaagctcaaaaagatggggttgagggaggagtcaaaacaactttcatacctgatgttttgatctccccatcaatctggtttttgagctagccatgaaggcctgcctggctctcattgatttcctttagggaaaaaacaaatgacaacacagtcattttagaattatttggggaacgctgcaaattgtgcagtaaggtttttatataaatggagagactctccaacactgccaacaagaaaattccaaaggtgcaggtagaatcggtctccacacctaggagtggggcaaagggctcctttggttctaaagaacctatttgtgtttcaaatatctttcagaaacttgacaccttgaaactaccactctcaaggaatctgagtaagtcctagaatcgctttcttcaaggagagcagcaagactcatcgctttgttaaagctctccctattcacccctagggcccaggcctggatgctggggttcagaacacccccttgctgccctaaggtccaacactacccagcatcagacgagaaatgacctcctttattacctgggtctgccaaaggacctggaaatccagcctggggtgggggtggggggagtcccagaaaccaaaggagcacacaggggccacagtgggaagagaacaggctgaagaaagcaagtgtcactaaatgtcaggtgtaagcttgaaaaataaacacaaagaatgtaaaacccagcagaagaaatttaacaaacctttgtggtaggctgggacaacggagacagatcacgtaccaagtgtaaagtaagtcacattttaagagtcagaaagtaccaaagaccacagattgttatcaaggtttatgtagatctcatactttttgcaaacatctatttaattagcttgtagagaaggatcttttgggcaaaataacattttcccaattccagggaatatttatgccttttaaattctgccaggaggcccctgacaggcaccagtgactcttcccttctcagcgatctgcatatttctagggaaactttgcactgagagagttttccccctttgtgaaaggtcttggcgcccaggcagtccccgacttcccctcccccaagtcctggcgactgtttctgctcagccctggaggctactctcccgcagcctcaggtttccctacttctgcagcgtcggcaccaagggctgatcaaatgtttctttctccttacaccggcggaccgggaaacgccgccgcagcctcgcctccatccttcctcctacaggttgcaaataaagtacagcagctctgacattaggcagtttctgtccaaggagcaaggtgacttcatttaatttgcactgtgctccttcatccctgtctgcatcaggttgaacgggaggctctccctactaccaaacgcctaacatttccttgatactgccttgaaaaatcatgattatgacaaaaataataacgtcggagaatggagtgcttgttttctgctttgcaagtcaccaagcaagaaaacacttttgtctccttggcttttattttaggatctctgagcgaaagagagaaagagaattttaagaaatgtcattttcgctttgccaaagatcattgtgtcaataacgtttctctcccattcctccccctcctcccgttttaaaggaaaggttcacgggtccagccaggtttctgccgcatcccgacacctggagacgtctttcaggaccagcctgaatcgcgtccgggctgggctctggactcggactcgcagcggtgacagcggaggcggggacgggggtggacaaactgcggatcaactctccgagaagacggccacctgccggaacctgccttcctccattccgcccaggagcctcgcagcggggcgctggcctgcggaaaggccacgggggagcacagggctccgcgccgccctcctgggagggtccggagtccagcgcaccccgagccctggtgggtgagcccggcgggaggcgcggcaggtgcggcgggagactggaccccgacctaccttcacaaagagctcgatctcggggtccctgtcgtccccgttagctgtcgccgagtctgtcatgccgttggcgcccggggctaccgtcccgggccggggaggcgccacctctgcagcacctgggccagcactctgcgctcctgccgctgcccagcggggctcctcttcagggcggtgtttaatttttcacaaaaccatctattctccagcccgagcagcggggtctgagagatcagtgtcccagatgctcacatgaaaaggagcgaagccgggaggaggcggggggccacggggaaagccgggttaagggaatgacaacaggtcgtgggagcaacaagtgccgggctgcccggaggtgtcacaggatccgcgactgtcagcgatcccgccgccgccaacgcgcccaaaat

SEQ ID NO: 201 - DNA, 39148 bp, Homo sapiens
cttttgtaatatttgaaaataaaccaactttatttgaatcagtcaataccaatcaagactggaacacaaattggtaattggttcagattcatgaggaaaacactcagctgtatcttcattaaaaggcattttacatttattaaggcttgaaagcaagtcctgttattcatcaccatagttaaaggtctcgagaaaatcaagtaactatcatttggagtgtctttgtaaaatgaaacacttgttcttttacaaaagctaagcatcttttgttaagctagttaactccccagcttataaaataggacaacgaggtggccaggaaagtaagacaaattcaaacatcagctggataatttatattttaaatatatgtatagtcaatattgtgaaatctctaactctacataaaatacttcagatgactggatccttaaaagtacattttaccaaaaacagattgcttctatagaaacacagaatagcccaaaccttatattgaggcaacgtattttatttatttttggttgcaagaaaggaattggatctatttctttaacgttaaatgaaattatgcacactttggatcatacataattatgaatcgaaagtatcctgacactaagctgggagatgcatactgacaaaggggaagaatgtgtgttgatgaggagggcacatgttgcttgatttgaatgataaagagaaatggatagaagacaatggggctgtgtgcagcaggtcctgttcgcttaagttttcctaacatcagaatcagggtgcttcacatgcacatgtctttctctgatgctttcttaagattctccttaatgtcatttaaaaaaataagaaagtgatcccttgggaatcattgtacttagttttaaccatgagttaacatttcctttttccaaggaggatgacaccagcatcttgattcaccgtgcagttgagatggcccctggccagtgggaattgaggcgagtcacagaagtacttaccaaatactcacctgctgcttctagtttaatttaattttagacacacactctcacagtgatgctaaactctttacaagatagacccgcagcttcctgcctctgcctctctcttagttctatttgtccaggccttgctgatttctgggactctcatatggtcaagatctatttcaggcatgacctatcttatgacagttctaagatgcttggtattgtctgtctgtggagtggccatggggcacagaactgtgaagagcttctgttgtttcatttgataagggcctggaaagtcagcctgggaaaactcgcacttggtgtggcctttttctgataagatcaagacttcactggccccaccagcacaagaagggaatgctgaggacagggccatttcccaagataaaactagtttgggatcgtgtggccaaataagctgatggactctgtttccgacatttcagctcatttgcttagtgctaggtcactctacctctcgtttaaaagaatatagctatgctcacatctgtgactctgaatttatcaagcatttgactttctttatcaggagatgaagaaactgtgctttggatccatcatgattttacttatccagcttactttttacagttattaaaatcttactcaataccttctctctgggccaaactcagaagcaggcattgctgactagacagtgaattcaactcagtcattctgagtttgactcttgcttctgccttcgtctcccactaccctgcttcccccacccccaatagtgctgtgcaagtcaaagaagataaataaatacaaaataaaataagatctcaacacaaatacatcccctttctgtgccaccaaaatgctttctgagcgatttgtattcattcaggaccaatgaaaaggaagcctcctaccctatagctgtatagttgtggggtcccaactgcagaccctcccgtgctccctgagttgttcttgggacacctaaggacctcaccacactgttgctgagacatgatgtgctgcacatatgataagaaggccagacaggctgaagcatctggagaaagatctcttttgaaacaaaaaaaaaaaggaaggtaatattaatattattgttactttaatataccataataaatctagtcataagacaccataactaactcttagtccatagtcacttgcattatatgataatccagtgctgaaatataaagaaatttctgaattaagtacccagaagtgccttccttctgtactcctccctctctttcaaatggctatcattgatcatataacacccccacctccttgtcttaatatatttatctctgtaaaactagctcaaccacagaagggacatctagaaacagcaatattgatttggtttggcctgtttgtttttaaggactttccagttgctgaattctgaacatccaatccgagtccttggaattctgcagacttctctggggtggagtggcctcaccggaggcttggttctgttttctctgtggcaattggctatgattcacagatgtgtttccagaacagcccaactgtgggtctcagggaagtaaactgcctcttaggtcatcctgcctgtgctgtaaattcggggaaggatttctgagtacagcaggatttcacactaattaaaaggccttcgggatcatttcagccctcatcccccaggaggccagtttggggcttttccctacagtaaaaaaggactctttcctcaccagttctccttgttaaacatctccagggcacaatttccagggggacctggaaaggttccttttgaggtggaaatgaatcaactcattccgccttttcaaagctttctcaggcttataaagtgtcctactgagaaagttcctcttcctcaatgggctctaggagacctcctgcttcctctcctctgatttgatcaatgggttactttttttcttcagagatccctggaggcaggtaggtccagggattgcttgggttagaatttgttgatatttctatggaaaggacccgtgctatcctgcccttgctgagaaatgagccaagtccaggggctttccagcacttgggagcctcaccctttaccagcgaacactatagaagggggattgttgaaggtaagggcctgtggcaaatggattttctcaccgggcgttcactgggagaaggagttgatgagtgcatttttcttagtttcctctgcacaggtccccaagctcaggctgggtaagctttttaggagatgaaacttaaggagaatgacaaaagagtgaaatattagcttaaaaatttttccttttttttttcacctggcagttgagtcagattgtaggaaaattaacccagatgggtctacatttttcttcaagttcaaaccacatggtttcctagtcagaaagtctcatggactttcttcctaaggtgttctatgatcagaccacctcctaaatgtggcttttacccattacaggctacagttgaatcaggcaggagcagctgctggagagcacccagccgacagacctgcattccagaagcagcttggagaaactgggaagacatttttgacccattcttgggtttttactgtaaggttagcagttacatgatgccaccagtccaagacttagatcatgagagaaggcctttttaaaagtttaccagggaacatcgaggctcataaagaactcttttgtcttcacccatctctcctcctcccactcccatccactttctcatagctcaaaaaccactcattggtaagcacagtcaaacccaggcctgtaatcacctctgaaacaactactcctaagcaagcaaaccccatggctggtagaccccgtgggtattttggcatcaacactgctcccctcccctcccatcccagtcactgcagtttagaattgcatgccaatttccttttctggcagggcctggacggcatggaagccagggacagcatgggccaggtgcgcagcagcagcagcgcagcattcctggcactgcaacaaactgagaatgtgtctcaagtgactttccagtctggcccttagtgcccaataaccagagtgtcagaagtagtgagactgaagctgtgtttgccagacacccaagtccatagccagctcggtactcctccattcactctctctgtctcccctaatggggtaatagatctctttctaagaaggatgaagatggcgtttgtccttggccttgtaggtatggacggagaggagggtagaaaaggagttggtgttgcatgtttctaaagcatctgagaaggtattttgatattggcagaagaagctagtggcaatcccatatgtgggctctccaacactgactgaccccaaacatgctgagcccagatcaggctggccggccgaaaggtggactgtgtctatcatttctgctagattcctatgtgaggaggccagggatggtgctgaccttcatgaaagatagcaggctggagttcccatgataccagcaagatgaggcttgattataaaaagtgcgcctcaaggcagtgatacagaggagtctatgaagctggagtcttaggggagtggttgagtccttctgcagcggggatggggcaaaatggctgtgctcaggatcggctgaggcgtttggcgacatcagcgtaggccaactcgatctcactgtcagctgcacaggtgttggtgaactcatcacgggcataggcgttcttgaggtaccgccacaggcctgtcatctcagccgggatatcatagttgcggtatttcttggccacaatctaaaacagagatggcaggacagaggtggtgtgaaggcatgaaacaaatcattagaaagtgttagtggccgtcccagtgtgtgtgcactgcaggaaacctccgtgcatcaccacgggccatcagtgatatgtttgaaatgcaaggtggcagtgctgtcttctttttgttttgttttaatttaatttcttaagtaaacataatttgccctttgacctagtgtgtcaaattctaggaattttttctcaggaaataatcatggatggatataaagatttacctacacaattatgatcccagagctattttgaataacaaaaatggtgcacagcgccaaagtccaacaatatatgaatacatacattatcttacacaaataaaatgtcatagtggagggacattaaaaatgatgctgctaagaaaatctagtgatctggaaaactctccaagatagactattacatttaaagttcaagtataatgcatttggagaaacatgtatgatggctagatgtctatatacctatatattaccagtggttatgtctgattgatagaattaccaacaatttttcttttcttctttctcttattcactttgttttacacaggccagtttttcccttctttatttatagaagggaaaaaaaaccatgaaaagcaagttagatattggaatgtatatgtaggtttagactatgacataaaagtaagcaaatactgatttctgttctcgccctggtttgccacagtcaggggggatgtggactggagagttctggagaagtggtatttatgttgagagaaacaagagcaaagtgattaaaagcatgggctctggataccaactgactggatttgcaatcatggctccacttagcagctgtgtgacattgggcaggttacttaacctttctgagctccaatttctttatctctaaaatggatataataataaaacctactttggagtaataaattagttaatacacatcaaatgcttagaggagtgcctggcaaatagtaaatactcaataaacatcaagtattattataattcattgagacctagcttgtacccatttgcatgcattttcttaatggggacagcaggatggtttctttaatgaggtctctctagctgcggcagcttcatggacctgtgacctgtgcagtctcaccttgcactcagaagagccctgctgttgatttaatgctctggggtcaatgtgtggaaattcttaataatttttaaacagggcccccctgttttcactgtgcactagggcctgcacattagctggtcctcctctagcccttccaggctaggctagggtaggggtaacaggagagtagtatcacttctgactcccctccctccctcttttctgtccctttccttccctccctactcccttccttccttccttccttccatccttcctctctctttctctcactctctctctccttctcttccttccttccctcttttttttggggggatacaagggggtacatgtgcaggcttgttacctgggtataacgcatgatgctgaggtttggggtatgattggtcctgtcacctaaataatgagcatagtttttctacacttgccccctccatccctctgccaagtagtccccagtgtctattgttgccatctttatgtccgtgagtacctattgcttagctcctacttataagtgagaacatgtagtttcatgttttctgttcttgcattagtttgcttaggataatggcctccagctgcatccatgttgctaaaaaggacatgactttgtttctttacatggctatgtagtattccatgatgtatatgtaccatgttttgtttattcagtacactgttgatgggcacccaggttgatttcatgtctttgctattgtgaagagagctgtcataaatatatgaatgcatatgaaatttttttggtaaaacagtttattttcctttggatatataaccagtaatgggattgcttggtcaaatgatagttctgcttttagttctttgagaaatctccagagtgactgaactaatttacattcccattaacactgtataagtgttcccttttctccacagactaaccaacatctgttgctttttgactttttcacaatagccatcctgactggtgtgagggaggtgtctccttgtgcttttaatttgcgtttctctggtgactggtgatactgagctttttttttttttttttaatgtttgttggccacttattatgtctttttttgagaagtgtctgttcatgtcttttgcccactttttaatggtattatttgtttttttcttattcaattgtttaagttccttatagattctggatattagacctttgtcagatgcatagtttgcaaatacttcctcccattctgtgggctaactgttcactctgttgatagtttctatgtgcagaagctctttagtataattaagtcccacttgtcaatttttatttttgttgcaattgcttttgtaacttcatcataaattacttcccaaaactgatgtacagaatgtttcctggttttcttctaagattcttacaagttgaggtaaatctttaatccatattgagttactttttgtatatgatgaaaggtaggggtccaatttcattcttctgcatagggatagtcagctattccaaaaccatttattgaataggaagtcatttccccattgcttatttttgtcaattttgtggaagatcagatgaccgtaggtgtgtggctttatttctgggttctcttttctgttccattcatctatgtgtctgtttttgtacaagtaccatgttgttttggttactgtagccttatagtgcagtttgaagtcaggtaatgtgacacctccagctttgttctttttgcgtagggtggctttggctattccggctcatttttggttccacacgaatttttagaatagttttttctagttatgtgaaaaatgacattggtagattgataggaatggcattgaatctgcatattgctttggacagtatggccattttatcaatattatttcttccaatttatgagcatggaatgtttttccatttgtttgtgtcagctgcaatttccttaagtagtgttttatagctccccttgtagagattttaactccctggttagatgtagtcctagatattttattttattttatttttgcagctattataaattggagtatgttcttgatttggctctcaactttaatattgttagcatacagaaatgctactgatttttgtacattgactttttttttttttttgagatggagtttcgctcttgttgcccaggctggagtgcaatggtgcaatctctgctcactgcaacctctgcttcctggattcaagcgattctcctgcctcaacctcctgagtagctgggattacaggcatgcgccaccatgcccagctaattttgtgtttttagtagagacagagtttctccatgttggtcaggctggtctcgaactcccgacctcagtcgatccgcctgcctcagcctcccaaagtgctgggattacaggcatgagccactgtgcccggccacattgactttttatactgagactttactgaagttgtttatcagttccagaagccttctggtgaagtctttagggtttttgaggaatagaatcacatcaccagtaaagagagagaatgtgacttcttcttttcctatttgtatgccttttatttctttatcttgcctgattgctctggcaaggacttccactactacattgaataggagtggtgagagtgggcatccttgtcttgttgcagttttcaaggggaattatcccagtttttgcccattcagtaagatgttggctgcagatttgtcatagatagatggctcttattattttgaggggtgttcctttaatgcctaatttattgaaggtttttgtcatgaagggatgttgaattttatccaaaggttttctgtgtctattgagatgatcatttcatttttgtttttaattctgtttatgtggcgaataacatttattgatttgtgtatgttgaaccaaccatgcatcctaagaagaagcctatttgatcaatgtgaattaactatttgatgtgctgctggatttggtttgctagtattttgttgtgaattttttgtgtctatgttcatcagggatattggcttgaagttttcttttttcattgtgtctttgtcaggttttggtatcagggtggtgctagcttcatagaatgagttaggaaggagtccttccttgatattttggaatagtttaagtacgattggtactggttcttctttttatgtcaggtaaaattcagctgtgaatccacctagtctggggcttttactggttggtaggtttttttaaattactgattcaatttcataactcaattagtatgttcagggtttcaatttcttcccaattcaatcttggaatattgactttgtatactgaacctttactgaagttgttgatcagttccaggagccttttggtgaagtctgtagggttttcaagaaatagaatcataatcagtaaagagagaatttaacttcttcttttcctacttgtaggccttttatttctttctcttgcccaattgctctggacttccactatgatgttgaataggagcggtgagtgggcatccttgtcttgttacagttttcaaggcaattgaaaagtgtatttctaggaatttatccatttcctctagattttctagtttgtgtgcatagggatgttcataatagtctttaaggatcttctgtatttctgtgagctcaattgtaatgtcttctttgtcatttctgattgtgcttatttggattttcttttttgttgttgttgttgttaatctagctaatggtttatggatcttctttatcctttcaaaaaaccaacttttggtttcattgattctttgtatgaatttttgggtctcaatttcattcagttctgctctgattttagttatttcttttactatactagctttgaggttagtttgttcctgtttttctagttcctctaggtgtgatgttactttgtcaatttgagatctttctaactttttgaggtaggcatttcgtgctataaactttccttgtaatattgcttttgctacatcctagagattttggtatgttgtgtctttgttttcatttatttcaaagaatgtttttacttttgccgtaattttgttgtttacccaaaagtaattcaggagtgagttgtttaatttcatgtaattgtgtgattttgagacatcttcttggtgttgatttctatttttgttccactgtggtccaagagtatgattgatataatttctattttttttaatttattgagatttgctttatgactgagcatgtggttgatcttggagtatgttctgtgtgcagatgaaaggaatgtatattctatggtcaatgggtggagtattcagtagatgtctgttatgtccaattgtcaagtgttgaatttgagtccagaatatctttgttagttttctgcctcgaagatctgtctaacgttgttagtgagttgttgaagtcccccattattattgtgtgttgttgctaagtcttttcataggtctagaagtacttgttttgtgaacctgggtgctccagtgttgggtgtgtatatatttagaatggttaagtcttcttgttgtagtcacccctttactattatgtaatgcccttctttgttctttttttttttttcactattgttggtttgtggtatgttttacctgatatgagaatagtgacccctgctcttttttatgttccatttgtgtaatagatctttcttcagccctttactttgagcctatgggtgttgttacatatgagaggggtctcttgaagacagcagatgagtggctcttattttttatccaaattgccactctatgtctttcaagtggggcacttagatcatttacattcaaggttaatattgatatgtgaggttttgatcttttcgtgaagctgttagctggttactttgtagtttctattgtgtgcttgctttatagggtctgttggctatttacaagtgtgtttttgtggtagcaggtatcattcttttgtttccatgtttagagtcccttaaggatctcttgtaagtatggtctaatggtaataaattcccttagcacttgcttgtctggaaaagattttatttctcctttgtttacaaagcttagtttggtgggatatgaagctcttggttggaatttctttctttaagaatgctgaaaataggccctcaatctcttctggcttgcaatatttctgctgagaagtctgctgttagcctgatggggttccatttgtatgtgttctgacctttttctctagctgcctttaagacttttttctttggcattgaccttggacagtttggtgactatataccttggtgaagttcattttgtatggtatctcacaggtgttctctggatttcttgtatctgtatatccaccttctaccttgctttcattttcagagagggccctagaccattgaccctgggatcctcccattcagagaagccccagatcagtcactctgggcttttgtctccattttggtgctggtaatatgcagagtttcccagaaagttatgctgaagtgaaggatgatgatgacttgatggatgaaaaactcactgttgcagacatgttcacagacatctgggaacattttttcccctctatgctcctaggccagtgttgaacttctgttataacactgagctataatctattctgaatcatgattactgtttcagtaccctttttttttctaacttgtgggcagtgtaaggatagcaatcacaggttcttcacttctgtactccttgataatctcaataatgatgttgatcagaggaatgataataacaaacatttattcactgtgtgctctgttccagggactgctttaagtactttgcaaggtacttaaatctctaaataatcctataaggaagaatctattatattcccatttacagatgagaaaagcaagacaaagggagattaaataggttgggattcaaagtttacaatcttatctgtacatcagacaaggttctctagtgtcaagtgtaataaaataattttaaagactgaagatccctagcaatgagcaaactgaagctacaagagattatgtgacttaatgttacatgataaattaattaatttaaccaatatctattgagttaccattaatatttattacagtccttgctttataatccacagttctttctactttactactcagccctacatagctgataaagcaatgggtcggtctactcagaatccctcatgttccagccattaatttactgttgcttgtctccaaacctactcttctatttactattttttgtgatgctggggctaggactgagcagatcacatctcttctttgccagtgaatcctgttaggttctgccaagaggagttactggagagagccagcaaggttggaggaggagaagggagggagaagcccatgcttttcagcttcctctttctgtcagagtctccatttatttctgggagcagcagctgaatccagtttgctattttgtcaatactcacaggaccacttcatcatacccacgcagagaggccagcacatagcaggaactctgctttagaggctggatcccagccaacctgagcttggaccctggcaccagctgagcatcactttcaccgacattcagctctgcagggtccctcatctacagagcccctaagtttgtaagttttaataattccaacctcttccctttgttcctcctgccctaggagtagtagctgcctcttgaaggtagaacctcctagtatattttgcctttccagttctttactacatagtacttccttaaattctctctgttaaaataactggtttggtgtgggcaccaaagaagccacccccacactgttctgtctggcttaggtaactacaagcaagggtgatgaagtccgagtcctttgataaagctctcacaatgagagatgccaccacgatatctccccagtccctttctgttcactgaaagatgatgatcccttgggttgggccaagttcctttgagaagaggctgtcttggctaagagcaaattcatgcaggagtggtggcctgaccaagagaactggctggaatttatcagagtggatgaaaagggtctccaataagataaagggatccaaaagtatttttcacagtgacacactgattcatagagtagcctcaagtcatttcatactgaaattttattttcaggattttaaagggcagaatgttagtttcaatacagcagaaatgcaatttgtaaatatatacttctattgatgttggtgttccccttcttgtttgtctccagggctgaacatcgtcactatgctaggcaaggatcccagtgagcaaggaaaggcctgcagatgcctctcccaacgaagacctgtgcaccctgggccttggctgctgagctggtcatttcttcacacattggcttgactttgggagatgagaactaggagggggccagacaatgaatgttcaagccaaactctcatggagagcctgggccagagcaactctgcttccagggatggagataaacctgaaagcgagccacgcaagaggagagtgagcatgaaagcagcaagggggtaaggatgcacacggagatctgacgttcgcagggacttccatgctcatgttctgaatttgctctttcatatgaaaacagttagctcccacagcccagattaagttttggcatccgaagccaaactggaggcctgacttggcttccccttcgctctttgtgaactttagaggtttgccaggtttctgggatctgataagctggatcagcagaaatccaaagagataggggccaagggctggcctttgttctttcattggccatcttctttttgatctccagcttctctgggttaaccacccactgaattttctccaaggacagggcttcactgagtaatttaaggcaggtgggaattgaggaaatcacaggatgaagcccaaggcttgggagattcatttgtttgctttgttcaacaaatggtttttgagtggtagtgaatacatgtttgagcaagagaaaaggaaagaaggagggaaagaagaaaggaaaagaaggcaagaaggaatacaatccacttctgttcttctaggcatgagaaaaatgaattccaaaaagattaaatgatgtgcctcagctcatgctgctagttggcagcaaatacaggaccggaactcgggtctcctgatctttgcattgtatcactctgacacagtgtgactgagctggaattatatcatccctttcagtggtacttgttcctaaggagaagaagaataaaggatgatgggtggggcatgcagtagttaataacttcaaagagacatagattggctggacctacaagtgactattggcttggccccaaatccaaaatgttcttttctaaataggttgtatttgcccactccatttttatgcatgattccctctcagtcttcagctctaaggcatacggaaacaccagtgtacacacaactgagtgacttcagctcaagctggtacatgctctggttggagaggagatagcatttttgactcgggacttgagctgaaaaataataggcatatactcagctgacagatgattgaatctgagtcttctcagtgaagcatagaaataaactggatatcgtaaagacttacaccaggtgatcaaatgatcaatcaatgagtatttattgaatggccactgtgtgcccaccatcacactttaaaaagttcctttcctcacagagtttgctgtctggctgagacagtaagatataagcatgcgtaaaatagagcacagtatggctatctgatactaggctgacgagggtcaggaaagaatgggggaagaagtgctcattgacagagcttagggggatacaactactgtcttcaaatgaggtgaaggcaagcaaagctgttctctgttactctagagaaaaaatggatagcagggaggcatgcttgggctcattgtaaagaacaatgatttaataatcagagctatctaacatggtagggctggctcattaagcagagggctcctcgttctcagaggctgcagtcacagcttcacagaagcctgtcacagaaacagcagaaagtggtccaggttgaagtgggagattgttttggatgacctctaaatgtcctttccaactctcagattcccagggtttgttatataggagaggatgacactacatgctgcaaatggttagtaagtgcaatgatagcaagaaagtgacatcacttcttgcaacctccacctcttcatttgatagatgaggaaaataatgtgggctcaccttaggaagttgctggaggaagtgagaaggtgggtctgtgcacaaagaaaaaatgcatatgagggcacatttaatagagctgtaggggtgtagccagggaaatcctatgaggaagaggcctttggagtgatatgactgtatacaacaacgataattgcgactattacacatattaagcccccacaatatgccaagcactttcacgctgtatttactcttccaccaacacttgaagtaagcaatatatgcctattttataaatgaaaactgaagctcaaggaggccacacagccaacaagcagcagagggtgaccttgggtccttattacctgacttcagggtccaggttcttgaccaacaggtggtactgtccttgactcatccacacaggtgacctgggcctaagatggagctggatcttgcaggcccctgtgggtagagctctcttaccttgaccacatggagcttgggcaacagattgcagtcagccagggtcagctcatccccatccaggaacttgcgccgggaccccttgtcttccccacaagtgttggcgtcaatctcctctggtagaggggtgttcaggtagtcatccaatttctttagagccttggttaggcctctttcaagagctggcatgaaagagtaaaagggcctttattcaaacttcttgccagtggatacagtcatagggtcttcagagtggagtagctcatctagaatcctgtccccttcatcacactgccagctccccacacactgcagaatacctggaaaccattaacacaatgcagtagaagtgtactaaataggctgaaaaggcaaactctaaccaaacaataaacactagctaatcttttgctttgaaaaaaatacataaatatagaaacacagtctgggtgtggtggctcacacctgtaaccccagcactttgggaggccgaggcgggcagatcatgacgttaagagatcgaaaccaccctagccaatatggtgaaactccgtctctactaaaactacaaaaattagctgggcatggtggcacgcgcctgtagtcccagctactcgggaggctgaggcaagagaatcgcttgaacccaggaggcagaggttgcagtaagtgaaataatactagccaatttatttatttatttgtttgtttatttatttttgagacagagtctcactctgtcactaagctggagtgcagtggcgtgatctgggctcactgcaacctccgactccctggttcaaacgattttcctgcctcagcctctcgagtagctgggattacaggcacaagccaccacacccagctaatttttgtatttttagtagagacggagtttcaccatattggccaatatggtctcgatctcctgacctcatgatcggcccgccttggcctcccaaagtgctgggattacaggtgagagccaccatgcctggccaatactagccatttttttaaaaagttttggttatctataatttgctaatattccacatcaacctacatattacatttttaggaagaaaaggctattaaatgggtaaatataaactatatagaagttccaagacaaagatatgcatcagatattgtggaagtattaactatagctaacccaacccaagaagagttggggacaaggccttcagggggacttgacagggggaatagaacagccctttttgatgtcacccccagagaagtgatgggtaccagggaagaacacttgggttactctagggaagcttgttctaaaaatcactgctgtctcaaatggaagggctccaccacaaatgtgcaacccccagctgcacagaaagctgtcatgattatgactcaaggaatgaacacccaaaggaacataacatgggagaaggcttttacagtcttggtcaaataattatctgtcacataatttatttagacacaaaagcagacaaaatacccaaaagaacaactgtgggaagccatcatcactgaaaatcgttttgcccagaatctcgtagtcctttctaatcagagaacactaccatagaaactttctacttgagctcaaaggacaaacatggaggagatggctgaccagggcatcagtcactgcacctgtgtcatcagccccatccccagactctggtttagagcctgacactgagataatggaagtcgatcctgctgttcattccagtagatacaaggcggacactgccttctggaggcaaagccaagagggctgtactcttgttcagattttcccaagtgtgccttgttagccactcctctcataacccactttttgtcttttcatagaaggccttttgtttgagacaatggaaagacaccagcccaagataaatcaattgaacacttactggaatgtttgaaaactgcctggaggttgggcatagtttctcaatactttcttctccctggtgtggcatttgaactacttcatcatctgctttgtgtttccagtttgggagaacagagtaagcagggctgggaaaatgcagtatattccttaataattgtctagactgtgatgggattgcaaggctattcaaaggcaatggcagagggtgggtactaaacaatgcttattatgcttttctccctgaagcacttgtgatttatttgtttgcttgctcaatccctctacccctttcattcctggagattacagcaaaatcttgattataatgaagaaaggaagaatcaaatactgggcctgtcaaaatttgaccaactaatatcatctgagggaaagagtcatacgataggagatgagacattgcaggttctaatctcaaatggccctggagacctgagtgggctgttgcacaagtctgtgcccatgtcaccaggtctgggaaatatcatgaaatttggtgaaaagcctagagcagtgattgaagttccttgggaagatagttctttatatccctccggtaattcctcgagatggaaggcatcaagtctggtgacaggaatcattgttgattcatgttgcaactgtgacattccatggagctttccaagtcagcacattctggaaggcaccctctgtgtatcagtctcctcacttgggtttgtgtatttttgaccaggaatgtgagggctgcagttggtaacagccgtggtagaggaagaggagacaaggcaacagggaaaggactgcaaggcctgggactaaactgtgtttaaatctcaaggccgcccagggtgaattcactgggaagctgctgagccttaagcttcaaggtgtcttgctttcctgggtcccttccaagcgcttggatctgatttcaagaattctgtattggtacttattgtattgccttaaggcttcataaatcccacaaatgtcgttgatcctggcacttacatgtgaccttggacaagttcctctacttcactgagtttctgctttctcatctcaataacgggactaaggatccttcaccctgttaagaccactgctggggttaactcagataatgcagggaaagcacctaatacagtgcctggccaatacgaggacatcaattaatggtagttgttgctattgccttaccaaacgtggggtcctcctgttctctgttccttgccccatactcttggtcaatatattcctgaatatcccaaggtgcagtggagaatgggtgattttaagaagctccaaatttgtggccaactccctggagaggaaaatcaatagcctggagatttgcttcccttacttatttagtatacagccaaagccctgttccttatactcccttgggatgctccttggtgataagctgtgttgaaaggcacacccatagcaaaatagacacaacatgcctgtgtgctgaaacactaccatattatcggatagcaaatggcagtacccactatacgctctgccaattcttttcctcccacctgccaactcattcctctgaccctggctcaatctgccatccatagaatttaatgatctcttttgactgatggtacacaggtcatgaaactatttgaactttctgctctggtaggaacaagggggatgtgaaagaaactagagcaacaaaaagatgttaattctttgtgtttaattcctcgtaaatatttgatatcctcactccacataattactctgagtagttagatgggggtatccctccaactacagcaagtgagcctagggttggggcacccaagacgcaggatcactaacatcccagggacttgatagatacccagtgttttaactgctttcttcccctctccgcctctgctccccatacagatttattctgtaccacacacaaatgcactgggtaaaatatgtgatgaggaaacaaggggaatagttcataaatattctgagccatatgcaaacaatcttagatttatttttctcttttttaaggaggaaaaaaaatccacccattccatgatcacttccagattcattgaggttgatattacataagacccaatattgttttctcgtcgtagagaaataatgacttggaaacagcaatttgagctaagaaaataatatattcttaccagggcatggaggctgaatggggactggggagccaagactctaacccagcctccaacaagttcttgcaagaacagctcagccctggtttgctggcaaactcagtgcagcacaggtcctgatgagcataaggcaaagcagactcctggggctcaaaattcacatggagaggagcagatatcaaaggtggtctttgaaagaatgagaacagctctgtgggcccaggtggctgcacgctcaacttctcatatatggtttttctcttgtatgtgtgttgcagcaaaataaaaaccaggaacccacctgtgaccgttgtctgtagattggatgggtgtctgttcaactctccatggagaaggaggttgtggttattgggcactggcctgggccgagtaccctctgccctatcttgttccttttattgccctagtcccataccttagcaccagcaaggaaatacactcactgaattcccgcagtgagctagggatgtttatgcaactaccatttaaacacacaatgaggctattgagatggaaaatattattcatcgtcattcaacagatgaagaaactgagtcttagacttacccagggcacatacgcttatgcaagcacacacatagctggtccttaaaccattcaaactactcctgggacgtacaatggaaatgtgccttgctttgttttcaactgctatggtcttccttacaagctcctaacctctgggtggtggaaaaacaacaacaactttaatttcgtccattttggattataacctagtctgatgtaatcatctaaatagtccccctagagaattctgtctctttgcattgatatgctcagtttcccagagaacctgcccctccttgctctccttcctgagtcagtggcactgggaattggggactaggcccctgtgacctcacagcactggggagatggggtttctggaatctatgggtggaaggctttggaaagcgaatacaggttctgcatttcttctgtttgcttccttccagagtaaccatggggatgctgggtgggggttacaggtgggctgcttgcctccctccacaatctggaaggatacccaagcaaagcaccacacggagctcttaacatgctctagttccctgaccctcccccccaccacctctcctttcttcttcatccccaactcccctgtgctaggaagggtgggcttttcttttagttttcccaggtcaaatggcccaccaatcattgagcagaaagcctcgcggccttgctgcatagccagtacaactgtttctactctgtgagtcgaggcctccaggcagggtttttgatgggtaaaaattgagaaataaaagagtttagaacatcttagacaataggttgggtaaaagtctactgtcttgttgaaaatgctattttgaagatcaaaagctgaatattgaattcttttttctgtcttagagttccttttacagaaatcctaatctctctgaggtcaatgaatgcctagggcagattagaatcacgtactcagagtgacagagagaaaaaaatgttcaatcgattagctctattataatttaggtgcaaagcccaggatttaagcgcagggctattagattctaaaacataaactccttctactctgcaaggccacttctgggtgcaaggactgtcccatcactccttgggtattcacgtggcctgacaggtgctgcaaaatgttctcattcccctgacaaaagaggatggggttcccctcatgactcccccatgccttaccttccaactaatttggtaacatatttgtgttctgctaccagtgcttgatttcagatataattcttagtactttcagcgaccgtgatgaggtcaagaaggagttttctctgagtagaggggcaaccatgacccatcacatcacttttcaactctgcctgtactaggggccagtgctgtcacacgggctgtgtgacaatgaaacatctggtcaaaaagtgagaaatccatttggatttttcctaggaggaaagaaatatctagatattgagaaatacctggagcactgaatgaagtttttacttttcatcttctcatttgagatcatgttgatataaccaaagggtgcaaaaaaagtacagtggtggtttgagaaagaccatggcagacggagatgtctctggccatcacatatttttgaagagaaaatacaaagatggccacacttgttgacatttgatagtttaaaacgtgaatggtaacgtgatggaaacaaaaaataataataagaagaatatcaccacttactcatctgttggaagaagaagcctttctttccacaggcagctaggacaagaggaagagacactgagagagatcagatggactaggccaaagatccaggagcaagcgggatgtaggagccccagcagggcccaggaggattgggagggtgaggaaaagggcaggtgcaggccaagcaggcagaaatgtagatgctgctataacgagctcaattttgaggagaggcaaagatattctaaggggattttgaggatgttcagctctgtgatgggcagtgtaaccaatcccctcccccaccagaaaactttacataaagatctgcattcatctttcaggttttagaaatgagtcatgtagcttttttctcagttgccaaagtccttaaagaaagagaacagtagcccagttacagttaggttatatgagtatgaatgaccacacaaaggcaaaattataaagcaggtggaaactggggttttctcatccgcagtgacctttctaggactcatggcaggtaagggggggctgattttcaggtccctttgtcttttaaataatgtctacaccagattcttagaccacatgaagtcagaaatggcagcaaggttttagaagatgggaaggggactttctatcaggtctgatgggacgctctctgctgtgcctgggccctctggctatgtttgcatgtcactggtttcatcaaggaagaaacagagaatctgggtcgagtatgtcggggagccatggcttctgataacaaacacagtagcagagcagcacattcactctgccataagagatttgggtttgaatcctcagttatgcttgttcacaggttcacatcatctagtgtctggtgcagagtgagacttgattaaagttaactgctattattattattacagctatagaacttgggtttatgagaggatgaaggggaagaagacaccgagagaaagatgagagaagagatagctcaaggcagaaattcagtgtctgaagtgaagtttatctgaacatcctagcatgttccaggtccaaggagaatcctggagagcttgcaggatgaagcttgctcttgactttcctaacatgttagggatctaaagttgcctggaagcatctctttgggtttggctttgctctctccaggccacatgggtgtgtcacattttcttagtttgacagtttagagagttcatgtccacctttggcactgaaccaagaacactggacttggcctcatagccagagaggaggatgttgtcaaattggccctgggtgtgaacaacccaggggctcacatgggggaggcaattcccaggcctccgtttctaggcactgctaaaaacaggaaaggcagaaagacaaacagcggtttatgagaaagcaaaatgcaatggcaacttcaacagattccccactgttccctcgtgtggcgtcagctgggctacagagagtgtgcagcacgtggtgccatgggtattatttgtttgttctagaaagaatttcagcctcagaggggaggatgaattaaatgacaagctcctatagttctttccagtaagaagccagtaaatgattctttatttgaaagatagcgtttaagtcttacaattatggtgggttgggatataggacactgttggttgcccaccctcctctgtggtggggagaatggggtgttttctgatgtatttccaaggaattcagaaactttcttaaggaagacacagattctccacatagctgcttccccaagctctataggggattcttataaagaagcatctttttatttaatacagctccacaaatcacccttatatttggcgtatgttcagaagtattagtacaacaacaaaatgcatattttttttaaaggcaagagactttggccagtatttggctatgtttaaaacaccagcatggtaaacatttaggacaactttagcatgcctttagtataatattttcttaaagtatgaagggaggtagggactccagatccaaataattttctaaacctcttaaaagccacagtagatttgaagagaaagattatcacttaggtcttcgaattaagtttccttttgtgtactcatctgtagcatgtaagctgcctgaatgtttatttatcaacaggagaagggaggaagagagagagagagaaagagagagagatagagagagagagagagagagagactgactgaatgtgggaggaagctgcagagctagcgagctcaggagtgatcaggggagaagttctggttagggaacccggcccagactttagccatggggcagtggcgacaccttctggcttatccctgagcaaacaaacaaacaaacaaaaaactccccaaaaacctattgtgtattttccacagagaacatgtacgtgtgttttctattagactttccagaaactcataaatgattgtagaacccatcgtgctaatagaaagtacggcataaatgctgacggaagctattaatgctgattgtagtttatgtggccaaatgaatcaggctgaaatctgtgagtttttttatggttactttataacaggttatttttaagtatcaggccatagattaggtttaatgcggatgctcacacacttagaatgagctggttaagagagattctaactttatcagtcatccgttccagcgtttagacctagagatttttctcaattctccctcccccaaaacacttaggctgaagtacattcaccacattttgtcttgtttcatcctcaaatagccacatcttttacataagagccattcacaaacttaaaaactgcctctgtgccactgcaatgctagactgaaataattactggatttggtgattctgtgaatatcctacaaattctcttccagttgcccattcttttatttgttaaacaggcatctattcggtgcccactgtgggccaactttgtgcccctttccccacatggattgctgggtgaggaccctgatggggaaggtgggaagtgttgagtatatttaaggaaatacacatggtagtcattcattgagtattcatcggatcgtgaactgatttgatcaccatttcctaaatgacacactcttgtttaattcagcactacatacatattaaatagtggattatattaaatgttaatatacgcaagtcaagagcacagatcatgggaccagctgcctgggctggggtcctgaccctgacacatactagcttgggcaggttgcttaaccggtgcttgtttccttctctgcaaagtggagatcataacatggcataccttagagggttgctgggagcaataattgagtcatcacctgcagagggcttagtacagtgcccggcatgctgtaagcagttgttatgtacaatgtgtatgtgcaacgcatgatgatgctgatgtatgagaaacaaagcatacaaaaaaagcaacaaaaaattcttagagctgcaagaaaaaagtggctcttgcctctggctctgctcagtaaacatcgtgcttgactcatcctctgccctgaaatgctgacatgaacagggatattcagctgttcctttcattctgactctacagccagaaccacagtcccccagccgaaagccttcatcataacagatgtgaaatggggcaaccttaaaggttgggggtgactgatacttacacagaattccccagatatgctacaagtacacctggacctccctcccccttgctcagagcagttccctggataccctaatgtgccccagcaaaaattacagtttgtggggagaagctacccattggatgtttgagttgcacagcttttactacatgagtcttgcatctcctaaagtttgaagtgtgtagcaaattaaatgtgcaattttatacttctgtttcctgaaatctagtagggggtaaatgactcagatttttccagcaccaaaggagaatttaaaatagtgtgtcctttttggcaatggctaggacaggtattttcaccagagagagaaaaaatatcaccttaacttgaaagtgaatatataagaattgaatatacaagaattcagtctccttttatttgttactagtagaagacagagcccatatatatatatattttcagggtagcaatgtgccctatcaaaaatactcatcttcctagattcccagaatttcagctacagaaggccaaataaccaagttctggctaaagagatatcggtagaaattaatcaatgggcttctgggaaagataagatagatgcggctggcattgtctggaatgcggatgtgatgtttgggggtggagcaaccatcctgtgaaacaagaatgaaagtcacacacgaaagatggagaattaggagctctaagcagcagctcaattctcgacttctttcagcaactacatttgcctggaactctctactctctggacttcttgtcatgtgagaaaagcaaattcctcttaagaagtaaacatttatcaagagtgcttagaacagggcatggttcatagtaaaatgctatataggttttgctaataaaatacatgtttgctttagccactgtagtcaggcttctattacaaacagccaaacacaacatttgccaatatacataggtattgccaacatgccaacatgtcattattccgctttttttttttttttttgagatagagtctcgctctgtcacccaggctggaatgcaatggtgcgatctcagctcactgcaaactccatctccctggctcaagcaattcttctgcctcagcctcccaagtagctgggactacaggcgcgtgccaccacgcctggctaatttttgtatttttagtagagactgggtttcaccatattggccaggctggtcttgaactcctgacctcgtgatccgcctgccctggcctcccaaagtgctgagattacaggcatgagccgtcgcgctcagcctcattatttcacttttattctagcaccttgcacagcgtatggtactgaataagtatttgttgaaagaataagccgttcagtggggtttgaggaaagatgaaggaccctaaaatcatgtgactctatttatatacttatgtaataagctttaactctgtagaggaacaacagttccctttctttgtataatagtagcccttggtcttttgaggatagatgaagggattcaattagtttggcctgagataccctcccacagagtcccagccactttgttatcagagccaagagagaagcataggttagcatcaacctctctgccaaacgactcaggtaggactgaggcagtttcagacctgggcaaaatgttgagtaaaactcatcttagggtccccacaatggaaacagaacatggataactatcattgcaaacatcagtgggcatgagaccatcagagttagagctgagtgcaggaggtctgagaaatcacgtggctcaaccctcccctccccagaatgttctggaagggaagaggttctagacactagcacagagaaacatatatacacacacacacatacacacacacacacacatatatacatacatatacatatatatatatatattttattttttttattttttttgaaatggagtctcgctctgtcacccaggctggagtgcagtggtgtgatctcggctcactgcaagctccacctcctgggttcatggcattctcctgcctcagcctcccgagtagctgggactacaggcacccgccaccacacccggctaaattttttttttttttgtatttttagtagagatggggtttcaccatattggccaggctggtcttgaactcctgaccttgtgatccgcccccctcggcttcccaaagtgctgggattataggcatgagccaccgcgcccggccagagaaacgtattttatttaccttgatccagatcattaaatgctttgtccaccaggggtcttagaaaaataatttgacctctggctgctagctgaaaaaagtctagaatttagccttctgtgttttctcttttgactcttggtgaagtatcacttttaacaccaaatagaatttcccttgaatgtggttataaaaataatggtgaaaagaaaaatcccacttcagcgaagcccgccagcacactggccatcctagtgaggagagctgctcaggttcttgcattcttttattgattggttctaagtgagattattcaccatgaagcttgatatcatataacagaggctacaaaagcattgtatgttctcacgtcaaagacaatgctagtcacagaacatcataggatttaaatggggactgggaagttttaaataaatacagtcagagcataggggagtctgcaacatggggacagatttaaaaggtgaggttccacagcggggacaggaagtggctggaggacgtgcccgtggctctgatgaggccccgtcatcatctcccaagcaaaggcatagacaaggtagaggtgtgttgaagtgtttgtatacttttttttctctcatttaacaaatattgatggaccatctgccctgggtcagatgctgagctggggtctggggtgacaatgatgaaggaggcacacccagcatgcttcctcacagagacagctgctcagaaccctgtttctcacagcacagccctggaccaacagtgtccgaatcgcctgggagctctcaggccttgccccagatccactacctcaatatctgcttcgtaacaagaccctgtgggaaaccaggatatgccacccccaaaataggaaggattgttgagatgaagacaattcagaagaaacagaggcagtaaagctctctgccctccctctatttgtctaaaagcaggacgtagatttacaaagacaaaacgtatcttgcctccccccttctaccagggagaaccactgaaaacaacttaagacgcttatgctcctggagatggccctgcaggaatctacattgaacaagctttgctaactggcctttatctgccattcatttgctatcccccgaagttgctgcccctagagactcaaagtgttttttcccttgtcacatctctaaaagtttactgtcctttgatgaggatgctgtgaaactagaattcaaagccatctctttgagaactcctcattatagaaaatatacatgttaataaacttctgcttgtttttctcttgttaatctgtcttttgttacaggggtcccttccaactaagaacctatgggggttattcttcctctaaaacccccacgggattcaaatgtattcgcaaggtagaaaatggtctggctaacaagaggaatgaaaagaagtgctgctttatgcttaagccttaagtctgtgcctgtcttaactcatgaggctactccggctcagcctggaaacaagcttgagatggggtggagtgccttcctgcaagacggcgctggagcaggatttgaaagaaagcctggggttttaaagccaaagttccatgtagcaactttttcccaacaaattaccctctctaaactgctgataaagtcagaataccagactagatttaatccctggttttagttcttatgtctttgcaacactagttggtagcaaaagatgtttaaaagctgagaaatgctgaagcttttgctagaaggttcagtgcaccacctggatttcacatcttgtcattttcagccccagctctaccaaaaatgagggaatctgttctacaggttaacttatccagagatattctcccctaaaggtcagcagaaacttggaaaaagtttcctcaaagctacgtcctaaccacagacaaggggttatgaatgtagtaattgtataaaccaactgtgatactttcaacctacacacacacaatgaaatgtagacacacacacccatggacacactattgtacttctgtggtctgcatatcctgtgcttagtgggatattgtgtcccatcatgaatatattgtgtcccatcatgaatataattttgcatgtaagcactttcttttagattaattgaaatgagcctgtctaaggaggtatgtgatggcctttgccagtacataagaacatcagaacacacacgaagtgcataagtgtgtgtgtgtgtgtgtgtgtgtgtgtagagagagagagattgagaaacgtatttggttcctatgtgtagactgcacaaagacaagaggtgttggttgcataggatgaggtaacggtaggaagaggtgaaagaacatttaactcatgtgcaaatcagttatttaacgttcctttattccccaggtcttgatctgcatccaggccaggccaggagaactcattctggtcagacagcgggaaattccaccacatggaatggtgttggtggtctccgctctactccagtccaggagcccacacagcaaaattccactaatgaatgcgcccacccacgcagggcccagctctccccacccccttctccccatgcctgccccattcaacaggccacgccaccaccaaccgccttccttacaactgcccaaggattcgtttcaggagcaagatttgttaaattataaattggaagcatccacctcaataatgaaccaaatcaaagaccctctggaggaatccctcaggcagctcatgggagggaccagaggaagcatttgcccactcctctccctcctgccctcagccccaaggaccctccatgagggaggagacgaggacatgcaagtgcagagcccaccagacctccgaggtgggtcccaccgagcctaggttatttgtttttccttacaagaatgctagtcaaagcaaaactttaacccaacaaaccaacaaacaaaatacccctagttggctatttgcacacaggggttgccaaggaaggcagcctgaagggtccctttgtgaccagaggcgtttttgaaaggagacagcaatggctgctttatgaggaagtggtgagacggtcacatgttatccgcattgctgtggaggtcggcctgaccacccaggagccttcaccaagatggcctgataacagcccaccgtggggctcccaggcctctgcagcggtcttcctgggacccaactgtcctccaaaagaactgcttccaacagagtagacatggagccccacggccacctaagtgactctgtttctgagcatgctacagggtaattaggtttcacattcctgctgctttttacacacggccttagctttctcatcaggcctgtggcagagcacaaggcagaatgagaaggggggtgccgcatccatcccctggatggccaggccctccagacagggccactgtgacacgggggctgggggctgggagggaggaaggggagaaggcatgaagcgccttatgattgaagtggcttggaataataaatatacacactcttttttaaacgtggctcaccacatcctgggaatctggaaaaaatgccccacttcactgtccctcaccctcctccccacctaccccccagcagcagtggctttcatgacgcctgggggaaagcacagggcctttgataataaggggcttgttagttctaggctaacagccctcccaggccgctctgaatcctttcaagcacttttttattttaggtcaaggaagttcgtaaatgtaaagactcgagattgtagaaggagaagaggaaagggagaaagaagcatttgggggtagttgtcattgggaggggcagccagggacctcctatggtagatccgtcaggcctggtggacatgcccttcccttggtgtgggggacagataatggaaggtggctttgagccttgaagaagacctagccttgtttgaaccgtctaagctttggcttagataaaactgaatctttgtataggaagaccctttcgaatccacaggccttgaataaatcacatcagctggctctggcgacgattcctctgcctgccagaagagggcagcacatgcttcctcattacagggaaagctgggctgcccagtccaaagggtggacactaggtatggaggcggggggagcactgtgaaattaatagcagcagcagcaacagcagcagcaatagctatcacatattggtgcctactgtgtgccaggaactgtcctaagtgatttatatgcattaattcatctaattaacatgacaaatcttcaagagagggtgctattacaatctccatattaccgttgaggaggctgaggcatactgaaattaacagaacttgctattgtagccacggactgcctaagattgaggtcagcaaattacagtccaaggactaaatccagttcactgcctactttcatgctgccctcaagctaagtattgttttgtgttttacatttttgcatggttggaaaaaagtcaaaagaagaataatatttcatgaagtgagaatgatgtgaaattcaaatttcagtgtccacgaatgatgttttattggaacacagccctatttatttgtttacatattatctgtggctgctttatgattcctgcagcagaattgagcagagtctggtagaggctatgtagcttgcaaagcctaaactatttactatctgaccctatatagagaaagtttgccaagccctgacttatgaggaagagctacctgtttccaggcaagagggacagagaacagagttgctatttactggaaatggagctagtatcgctatcccagggcaatttagaagcaatgttgaacttgattcactttttttccaacagggcagctcaaggtcaagcaaaaggagggtctgacatgtcactgaatagcctcaaggaagtaataaaaggttagatctggaaaggactgtgaaagtccactattatgtctcaagtctaaggtgcacatttttttcactctttaacatctgtgaaatcaggcaatgtcttacaatcaaaatatgagaggttaagtgaaaacactttgtttaagtgatagcattttgttgttgtttcttagaggtttgtttgtttgtttgtttttgagatggaatcttgctctgtcacccaggctaaagtgcagtggcatgatcttggctcactgcgacctctgcctcccgggtttaagtggttctcctgcctcagcctcccaactagctggaattacaggtgtgcgccaccatgctcggctaatttttttgtagttttagtagagactgggttttgccatttggccaggctgatctcaaactcctgacctcaagtgatctgcccacctcggcctcccaaagtgctgggattataggtgtgtgccactgtgcccagccagtatttaaaataatagtgtcgtacaatcaatgacaccttagattaggcagttcctgcctccaaagatccagcctctttttggtcctttctgttgatgggatactcacttcttttgctggcagtccattctacagatttaattttaaagtttcttttcttttttctttttagacggagtctcattctgtcgccaggctggagtgcagtggcaccatctcggttcactgcaacctacaactccctggttcaagtaattctcctgcctcaacctctcaagtagatgggatataggcacatgcccccacgaccagctaatttttgtatttttagtagagacggggtttcaccatgttggccaggacggtctcaaactcgtgacctcgtgatcggcctgccttggcctcccaaagtgctgggattacaggcgtgagccaccatgcccggcctaattgtaaactttctaatgttgagctgaagtgtgtaagcctaaattttctatacatcaaatgaggatgatcttgcttaatacgtttactttaagagtcttaagatcttattaaaagggagcgaagggaaggaagcactgtgacccccggggtagggaggaccagagccggctgcaggaatcagtctgtcggtgtggtcacaccaggcagtctgcaagatgggaggacagggatgagttgttggggacacaaaccatgaaaacctggaaggaaaagaaagaccgccagtgatacagatgagttctttttctagcagcatcagccaggagcatgacccactgcaggtggcacctcttagaaggagaagacaggagcaatttgaagattcgggcctgaatggaacaagaagacaaggaaagagcgaggaatgcacctgtggctggcttgcccctgctgccttatatgagggctctaggagatgaggaagggaaatgagagaggcaggatgacagtcattgatattgtgttaataagaaccacaatgtcctccttcaatcacgttcccattcagtgggaatgatcatccaaattctgagataaactcactgaggttcctagaataacccgagagtcttcttccattctatgtggcagggacaatcaatttttccagaataagcccagggagcttccaggttccagaaagaggagcctctgatgtgagccttagggaggtggaaaccttggcctttatttggaaacagaaccaagactgctcagggacctgtgtggctaatggccacttttttgttccagcaacaaattgggaaccaggaggtggtgggaactagggtacactccctcgccctctggtaaccacgtttgagcttggattggagagaaaggagaagcagagggcttagccctaaccaggtgcttttcatctggggacatgtgtcctggatttcctgggacagtaccaatttcttataatttgattattttcaatgaaggcaatttgttaggcatctgattttcagtttggaaaacatggccactgcagttacaactgatgaagggcaatgcaatctgagcacatgcccagcacgtcacagataccaaggaaggtttttagggctttctttcggaagttagaagcaccttattaggacaagtattttaggaagagtatgttaggacatctcagagtcttccataaaaagagaactaggtgcagccttgcgagtgaaaggggtacatctttgcacatctagtgcaggagcccattcatcttgatgaaaatagataagcccagacaggctgttctgtgtcccatgtgctgggtggacagagaggggcagggaggttggcgacacacgcctgaggctgcagggaggtctcctgagtcttccagagaagatggagagaaaggaagaaagtgagtttcaggtgaagagagaacacagggattgtgagatcgggaggagcacagctcacaggtgggggaagatggagaggagtcagagcagcaggaagtcagcagggcctggagtctacagcagcctgaaagagaagtcacaggaggggagagccaaagaaaatggaaaccacagctcctccgtgcctgcggctcacagcaggaatatttgttattcttctgggaggctggtttgtttttatcttctaggaggaccgagctgcagctgaccaggggccctgttttgctttgtctgctcacaagtttagagccaaatttgtggtctaccttctgtgtggcgcacgaaggccccggggctgccctgactgttttagctcacccagggctccatttgatggttgtctccttgtttttctttctcacctcctcttggcctttgttggtttgccgtgctttatgcatccctgggagtagctataaagcctttctggaacaagtggagtataaattttaaaatagaaagaaggccccccaagacagaggaatacagaggtggaaataagagagaaaagtggacttgaagggggaagaaaagagggaattcaaaggaagccttgaaagactaaaaccatccagattgggcaaaacaccacttagtgcaggtcgcctgggaggcctgagagagcttaagccccaagactgcatgtgatacagatgagatactattgcccctggggcttttcagacctctcactaggggaaagggagtcctgtggaagtgggctgcgcaaaaggaggttggatggaaggtggtcagcgtgaatagagcaggagaaatactgaatttttgtcttaggctacaggcataggcatgcctacttcctctccagctaaaaagaaaaggggcaaaagcacatgagaatatgacactggcaccaaaaacaaggatggtaattcttggtaggacattaactgtatctgagggaaacatgatagacctggaagaaattttaaaaaggggtaggagacttttcaaattagttaatcaaaatagagcattcaagatgcacattagatccatttgttaattacctgccatatgcgatggggacagaacatgaaataaatcatgtgtattgctaggattgaagcataaggaaagagagattgtggaaaataaagtgaaatatagcactttctgcctagattatgataagtaactaaaatgaatttcttgaaaaccaagagatttgcagggatttttagagtctgttcaaatggcagattgagggtaagaaatgcaaaatgtaagacagatattcagagggagaagtccacatcctcttaggaatgacagagagtgggggacatgttaaagtaggtgtcaaagaaacccctttagggaagagacaaacccaaggagccaaaggggtgttccagtggcaggcggggaggggtgtttcacagcgacgcttgctagaggtggaggcactggcttgcagaaggtggaggcctgggcccttgctgaactccaccatgtgccaggcaggctgggtagagagcatgattaagggggaggacagacctaactgcttgctaattacagggatgctgcaggatgtgccaaaggggcatggatgacactgtgccctccctcaagccttctacttcagcactctatgaacctccaggtctaaacccagggcataacttctccctgcaagattgaaaaagtgaatgtggggctcagaggaggaacccctccagccaaatctaaatgcagtgctgctttctcccatctcaaagatgctctttcgcaggaccacgagcactcttcccatgtgggttcctgatccagttccctatcatcacccactggtcctcccctttctaagggagcagggtttgtgcttcctccatcagactgagctctctctggttgtgtagaatctgagtaatgggtggattccacatgagaaaagcagacagaaaaggatatccaagaacactttcagggagctgcacatagcaggcaaaagtctcccaggaccttctctgcagcattttataacacagatcactcttttaaaacaacaacaacaacaataaagcttgctttcccatctttatgccctccccactacccccgatttcctccatcctccctggctagtccttctttctcttcctccttgactcctctccctctgtcatcccatctatgtgattgatccttgggcatcgtcttaatcatctaaagatgtataacccctcaaactgcatttttataccagaactctctgctaaggtacaattgtctacccgagataactgctcagaacaacggctgactttttttttttttttttttttttttgagatggagtttcactcttgttgcccatgctggagtgcaatgacgtgatctcggctcactgcaacctccgcctcccgggttcaagtgattctcctgcctcggcctcctgagtagctgggattacaggtgcttgtcaccataccctgctaatttttgtatttttagtagagatggggttttgtcatgttggtcaggctggtctcgaactcccaacctccggtcatctgcctgccttggcctcccaaagtgctgggattacaggggtcagacaccatgcctggccccagcagctgactttgaacgtggtagtgggcattattccaagcacacttatgaggtatacacagttattacccccatttcacagatgaggaaactgaggcattacagagttgaagtaacctgtgccatgttacaaggacaagaggcaaagctggtgtctgaactctgaactctaaagtagttggctttagagtctgcaagttgagccatacacagtcacctgcctctctgcataggaaacacagcatgtttagaaacaccgtccttatccttctccccaaaaccaggcgtgtgggtgagagatcttagagcacaagaaaacgaagcaacttccccaagtagcacctgacttaatgtgggatcttgccaccgagtcatgagaaaatccagtctacatttaagtgaagtgaagagcaggttggaaagagtgagaggagggggcatggaggcagtatctggttactgcagaccaaggggacctggatctagaaattacagaggaggggtgagtacagtgataggcctaaacacggagcacagaatcgtccctcagggaacaaaaaaaaatgcaaggctgctgaggtatgagagttgggccaggccactgacgctccttgatgacactttggagaggaggaccatgcaccaacaaagtttaaaaagtagaaaatagactgaatgggtgggagatttggaagagctaactgagggggaagcaagagctgaagcagcagtttctgatgtcattattcatcttagtcccatttttgtgctaatagcaataatcagaataatcaaatttaacagttacgaggccagacactgcgctaagggttttacatgcgctgagttataaaatagatgaacctgcattacaaaccttggtgatattattaattaccttattgccagataaagaaactgaatgtaaagtccattttacagatgcagagccagaggctcagaaagaataagcctcttgggtaaagttgtgcagctagaagtgctgggattcaaacccaggccgggaattgcacatgtacttgttttacagctccctgtagattgttagttcatggagggcaatgactttg

SEQ ID NO: 202 - DNA, 39148 bp, Homo sapiens; identical to SEQ ID NO: 201

SEQ ID NO: 203 - DNA, 25976 bp, Homo sapiens
gtcatttcatactgaaattttattttcaggattttaaagggcagaatgttagtttcaatacagcagaaatgcaatttgtaaatatatacttctattgatgttggtgttccccttcttgtttgtctccagggctgaacatcgtcactatgctaggcaaggatcccagtgagcaaggaaaggcctgcagatgcctctcccaacgaagacctgtgcaccctgggccttggctgctgagctggtcatttcttcacacattggcttgactttgggagatgagaactaggagggggccagacaatgaatgttcaagccaaactctcatggagagcctgggccagagcaactctgcttccagggatggagataaacctgaaagcgagccacgcaagaggagagtgagcatgaaagcagcaagggggtaaggatgcacacggagatctgacgttcgcagggacttccatgctcatgttctgaatttgctctttcatatgaaaacagttagctcccacagcccagattaagttttggcatccgaagccaaactggaggcctgacttggcttccccttcgctctttgtgaactttagaggtttgccaggtttctgggatctgataagctggatcagcagaaatccaaagagataggggccaagggctggcctttgttctttcattggccatcttctttttgatctccagcttctctgggttaaccacccactgaattttctccaaggacagggcttcactgagtaatttaaggcaggtgggaattgaggaaatcacaggatgaagcccaaggcttgggagattcatttgtttgctttgttcaacaaatggtttttgagtggtagtgaatacatgtttgagcaagagaaaaggaaagaaggagggaaagaagaaaggaaaagaaggcaagaaggaatacaatccacttctgttcttctaggcatgagaaaaatgaattccaaaaagattaaatgatgtgcctcagctcatgctgctagttggcagcaaatacaggaccggaactcgggtctcctgatctttgcattgtatcactctgacacagtgtgactgagctggaattatatcatccctttcagtggtacttgttcctaaggagaagaagaataaaggatgatgggtggggcatgcagtagttaataacttcaaagagacatagattggctggacctacaagtgactattggcttggccccaaatccaaaatgttcttttctaaataggttgtatttgcccactccatttttatgcatgattccctctcagtcttcagctctaaggcatacggaaacaccagtgtacacacaactgagtgacttcagctcaagctggtacatgctctggttggagaggagatagcatttttgactcgggacttgagctgaaaaataataggcatatactcagctgacagatgattgaatctgagtcttctcagtgaagcatagaaataaactggatatcgtaaagacttacaccaggtgatcaaatgatcaatcaatgagtatttattgaatggccactgtgtgcccaccatcacactttaaaaagttcctttcctcacagagtttgctgtctggctgagacagtaagatataagcatgcgtaaaatagagcacagtatggctatctgatactaggctgacgagggtcaggaaagaatgggggaagaagtgctcattgacagagcttagggggatacaactactgtcttcaaatgaggtgaaggcaagcaaagctgttctctgttactctagagaaaaaatggatagcagggaggcatgcttgggctcattgtaaagaacaatgatttaataatcagagctatctaacatggtagggctggctcattaagcagagggctcctcgttctcagaggctgcagtcacagcttcacagaagcctgtcacagaaacagcagaaagtggtccaggttgaagtgggagattgttttggatgacctctaaatgtcctttccaactctcagattcccagggtttgttatataggagaggatgacactacatgctgcaaatggttagtaagtgcaatgatagcaagaaagtgacatcacttcttgcaacctccacctcttcatttgatagatgaggaaaataatgtgggctcaccttaggaagttgctggaggaagtgagaaggtgggtctgtgcacaaagaaaaaatgcatatgagggcacatttaatagagctgtaggggtgtagccagggaaatcctatgaggaagaggcctttggagtgatatgactgtatacaacaacgataattgcgactattacacatattaagcccccacaatatgccaagcactttcacgctgtatttactcttccaccaacacttgaagtaagcaatatatgcctattttataaatgaaaactgaagctcaaggaggccacacagccaacaagcagcagagggtgaccttgggtccttattacctgacttcagggtccaggttcttgaccaacaggtggtactgtccttgactcatccacacaggtgacctgggcctaagatggagctggatcttgcaggcccctgtgggtagagctctcttaccttgaccacatggagcttgggcaacagattgcagtcagccagggtcagctcatccccatccaggaacttgcgccgggaccccttgtcttccccacaagtgttggcgtcaatctcctctggtagaggggtgttcaggtagtcatccaatttctttagagccttggttaggcctctttcaagagctggcatgaaagagtaaaagggcctttattcaaacttcttgccagtggatacagtcatagggtcttcagagtggagtagctcatctagaatcctgtccccttcatcacactgccagctccccacacactgcagaatacctggaaaccattaacacaatgcagtagaagtgtactaaataggctgaaaaggcaaactctaaccaaacaataaacactagctaatcttttgctttgaaaaaaatacataaatatagaaacacagtctgggtgtggtggctcacacctgtaaccccagcactttgggaggccgaggcgggcagatcatgacgttaagagatcgaaaccaccctagccaatatggtgaaactccgtctctactaaaactacaaaaattagctgggcatggtggcacgcgcctgtagtcccagctactcgggaggctgaggcaagagaatcgcttgaacccaggaggcagaggttgcagtaagtgaaataatactagccaatttatttatttatttgtttgtttatttatttttgagacagagtctcactctgtcactaagctggagtgcagtggcgtgatctgggctcactgcaacctccgactccctggttcaaacgattttcctgcctcagcctctcgagtagctgggattacaggcacaagccaccacacccagctaatttttgtatttttagtagagacggagtttcaccatattggccaatatggtctcgatctcctgacctcatgatcggcccgccttggcctcccaaagtgctgggattacaggtgagagccaccatgcctggccaatactagccatttttttaaaaagttttggttatctataatttgctaatattccacatcaacctacatattacatttttaggaagaaaaggctattaaatgggtaaatataaactatatagaagttccaagacaaagatatgcatcagatattgtggaagtattaactatagctaacccaacccaagaagagttggggacaaggccttcagggggacttgacagggggaatagaacagccctttttgatgtcacccccagagaagtgatgggtaccagggaagaacacttgggttactctagggaagcttgttctaaaaatcactgctgtctcaaatggaagggctccaccacaaatgtgcaacccccagctgcacagaaagctgtcatgattatgactcaaggaatgaacacccaaaggaacataacatgggagaaggcttttacagtcttggtcaaataattatctgtcacataatttatttagacacaaaagcagacaaaatacccaaaagaacaactgtgggaagccatcatcactgaaaatcgttttgcccagaatctcgtagtcctttctaatcagagaacactaccatagaaactttctacttgagctcaaaggacaaacatggaggagatggctgaccagggcatcagtcactgcacctgtgtcatcagccccatccccagactctggtttagagcctgacactgagataatggaagtcgatcctgctgttcattccagtagatacaaggcggacactgccttctggaggcaaagccaagagggctgtactcttgttcagattttcccaagtgtgccttgttagccactcctctcataacccactttttgtcttttcatagaaggccttttgtttgagacaatggaaagacaccagcccaagataaatcaattgaacacttactggaatgtttgaaaactgcctggaggttgggcatagtttctcaatactttcttctccctggtgtggcatttgaactacttcatcatctgctttgtgtttccagtttgggagaacagagtaagcagggctgggaaaatgcagtatattccttaataattgtctagactgtgatgggattgcaaggctattcaaaggcaatggcagagggtgggtactaaacaatgcttattatgcttttctccctgaagcacttgtgatttatttgtttgcttgctcaatccctctacccctttcattcctggagattacagcaaaatcttgattataatgaagaaaggaagaatcaaatactgggcctgtcaaaatttgaccaactaatatcatctgagggaaagagtcatacgataggagatgagacattgcaggttctaatctcaaatggccctggagacctgagtgggctgttgcacaagtctgtgcccatgtcaccaggtctgggaaatatcatgaaatttggtgaaaagcctagagcagtgattgaagttccttgggaagatagttctttatatccctccggtaattcctcgagatggaaggcatcaagtctggtgacaggaatcattgttgattcatgttgcaactgtgacattccatggagctttccaagtcagcacattctggaaggcaccctctgtgtatcagtctcctcacttgggtttgtgtatttttgaccaggaatgtgagggctgcagttggtaacagccgtggtagaggaagaggagacaaggcaacagggaaaggactgcaaggcctgggactaaactgtgtttaaatctcaaggccgcccagggtgaattcactgggaagctgctgagccttaagcttcaaggtgtcttgctttcctgggtcccttccaagcgcttggatctgatttcaagaattctgtattggtacttattgtattgccttaaggcttcataaatcccacaaatgtcgttgatcctggcacttacatgtgaccttggacaagttcctctacttcactgagtttctgctttctcatctcaataacgggactaaggatccttcaccctgttaagaccactgctggggttaactcagataatgcagggaaagcacctaatacagtgcctggccaatacgaggacatcaattaatggtagttgttgctattgccttaccaaacgtggggtcctcctgttctctgttccttgccccatactcttggtcaatatattcctgaatatcccaaggtgcagtggagaatgggtgattttaagaagctccaaatttgtggccaactccctggagaggaaaatcaatagcctggagatttgcttcccttacttatttagtatacagccaaagccctgttccttatactcccttgggatgctccttggtgataagctgtgttgaaaggcacacccatagcaaaatagacacaacatgcctgtgtgctgaaacactaccatattatcggatagcaaatggcagtacccactatacgctctgccaattcttttcctcccacctgccaactcattcctctgaccctggctcaatctgccatccatagaatttaatgatctcttttgactgatggtacacaggtcatgaaactatttgaactttctgctctggtaggaacaagggggatgtgaaagaaactagagcaacaaaaagatgttaattctttgtgtttaattcctcgtaaatatttgatatcctcactccacataattactctgagtagttagatgggggtatccctccaactacagcaagtgagcctagggttggggcacccaagacgcaggatcactaacatcccagggacttgatagatacccagtgttttaactgctttcttcccctctccgcctctgctccccatacagatttattctgtaccacacacaaatgcactgggtaaaatatgtgatgaggaaacaaggggaatagttcataaatattctgagccatatgcaaacaatcttagatttatttttctcttttttaaggaggaaaaaaaatccacccattccatgatcacttccagattcattgaggttgatattacataagacccaatattgttttctcgtcgtagagaaataatgacttggaaacagcaatttgagctaagaaaataatatattcttaccagggcatggaggctgaatggggactggggagccaagactctaacccagcctccaacaagttcttgcaagaacagctcagccctggtttgctggcaaactcagtgcagcacaggtcctgatgagcataaggcaaagcagactcctggggctcaaaattcacatggagaggagcagatatcaaaggtggtctttgaaagaatgagaacagctctgtgggcccaggtggctgcacgctcaacttctcatatatggtttttctcttgtatgtgtgttgcagcaaaataaaaaccaggaacccacctgtgaccgttgtctgtagattggatgggtgtctgttcaactctccatggagaaggaggttgtggttattgggcactggcctgggccgagtaccctctgccctatcttgttccttttattgccctagtcccataccttagcaccagcaaggaaatacactcactgaattcccgcagtgagctagggatgtttatgcaactaccatttaaacacacaatgaggctattgagatggaaaatattattcatcgtcattcaacagatgaagaaactgagtcttagacttacccagggcacatacgcttatgcaagcacacacatagctggtccttaaaccattcaaactactcctgggacgtacaatggaaatgtgccttgctttgttttcaactgctatggtcttccttacaagctcctaacctctgggtggtggaaaaacaacaacaactttaatttcgtccattttggattataacctagtctgatgtaatcatctaaatagtccccctagagaattctgtctctttgcattgatatgctcagtttcccagagaacctgcccctccttgctctccttcctgagtcagtggcactgggaattggggactaggcccctgtgacctcacagcactggggagatggggtttctggaatctatgggtggaaggctttggaaagcgaatacaggttctgcatttcttctgtttgcttccttccagagtaaccatggggatgctgggtgggggttacaggtgggctgcttgcctccctccacaatctggaaggatacccaagcaaagcaccacacggagctcttaacatgctctagttccctgaccctcccccccaccacctctcctttcttcttcatccccaactcccctgtgctaggaagggtgggcttttcttttagttttcccaggtcaaatggcccaccaatcattgagcagaaagcctcgcggccttgctgcatagccagtacaactgtttctactctgtgagtcgaggcctccaggcagggtttttgatgggtaaaaattgagaaataaaagagtttagaacatcttagacaataggttgggtaaaagtctactgtcttgttgaaaatgctattttgaagatcaaaagctgaatattgaattcttttttctgtcttagagttccttttacagaaatcctaatctctctgaggtcaatgaatgcctagggcagattagaatcacgtactcagagtgacagagagaaaaaaatgttcaatcgattagctctattataatttaggtgcaaagcccaggatttaagcgcagggctattagattctaaaacataaactccttctactctgcaaggccacttctgggtgcaaggactgtcccatcactccttgggtattcacgtggcctgacaggtgctgcaaaatgttctcattcccctgacaaaagaggatggggttcccctcatgactcccccatgccttaccttccaactaatttggtaacatatttgtgttctgctaccagtgcttgatttcagatataattcttagtactttcagcgaccgtgatgaggtcaagaaggagttttctctgagtagaggggcaaccatgacccatcacatcacttttcaactctgcctgtactaggggccagtgctgtcacacgggctgtgtgacaatgaaacatctggtcaaaaagtgagaaatccatttggatttttcctaggaggaaagaaatatctagatattgagaaatacctggagcactgaatgaagtttttacttttcatcttctcatttgagatcatgttgatataaccaaagggtgcaaaaaaagtacagtggtggtttgagaaagaccatggcagacggagatgtctctggccatcacatatttttgaagagaaaatacaaagatggccacacttgttgacatttgatagtttaaaacgtgaatggtaacgtgatggaaacaaaaaataataataagaagaatatcaccacttactcatctgttggaagaagaagcctttctttccacaggcagctaggacaagaggaagagacactgagagagatcagatggactaggccaaagatccaggagcaagcgggatgtaggagccccagcagggcccaggaggattgggagggtgaggaaaagggcaggtgcaggccaagcaggcagaaatgtagatgctgctataacgagctcaattttgaggagaggcaaagatattctaaggggattttgaggatgttcagctctgtgatgggcagtgtaaccaatcccctcccccaccagaaaactttacataaagatctgcattcatctttcaggttttagaaatgagtcatgtagcttttttctcagttgccaaagtccttaaagaaagagaacagtagcccagttacagttaggttatatgagtatgaatgaccacacaaaggcaaaattataaagcaggtggaaactggggttttctcatccgcagtgacctttctaggactcatggcaggtaagggggggctgattttcaggtccctttgtcttttaaataatgtctacaccagattcttagaccacatgaagtcagaaatggcagcaaggttttagaagatgggaaggggactttctatcaggtctgatgggacgctctctgctgtgcctgggccctctggctatgtttgcatgtcactggtttcatcaaggaagaaacagagaatctgggtcgagtatgtcggggagccatggcttctgataacaaacacagtagcagagcagcacattcactctgccataagagatttgggtttgaatcctcagttatgcttgttcacaggttcacatcatctagtgtctggtgcagagtgagacttgattaaagttaactgctattattattattacagctatagaacttgggtttatgagaggatgaaggggaagaagacaccgagagaaagatgagagaagagatagctcaaggcagaaattcagtgtctgaagtgaagtttatctgaacatcctagcatgttccaggtccaaggagaatcctggagagcttgcaggatgaagcttgctcttgactttcctaacatgttagggatctaaagttgcctggaagcatctctttgggtttggctttgctctctccaggccacatgggtgtgtcacattttcttagtttgacagtttagagagttcatgtccacctttggcactgaaccaagaacactggacttggcctcatagccagagaggaggatgttgtcaaattggccctgggtgtgaacaacccaggggctcacatgggggaggcaattcccaggcctccgtttctaggcactgctaaaaacaggaaaggcagaaagacaaacagcggtttatgagaaagcaaaatgcaatggcaacttcaacagattccccactgttccctcgtgtggcgtcagctgggctacagagagtgtgcagcacgtggtgccatgggtattatttgtttgttctagaaagaatttcagcctcagaggggaggatgaattaaatgacaagctcctatagttctttccagtaagaagccagtaaatgattctttatttgaaagatagcgtttaagtcttacaattatggtgggttgggatataggacactgttggttgcccaccctcctctgtggtggggagaatggggtgttttctgatgtatttccaaggaattcagaaactttcttaaggaagacacagattctccacatagctgcttccccaagctctataggggattcttataaagaagcatctttttatttaatacagctccacaaatcacccttatatttggcgtatgttcagaagtattagtacaacaacaaaatgcatattttttttaaaggcaagagactttggccagtatttggctatgtttaaaacaccagcatggtaaacatttaggacaactttagcatgcctttagtataatattttcttaaagtatgaagggaggtagggactccagatccaaataattttctaaacctcttaaaagccacagtagatttgaagagaaagattatcacttaggtcttcgaattaagtttccttttgtgtactcatctgtagcatgtaagctgcctgaatgtttatttatcaacaggagaagggaggaagagagagagagagaaagagagagagatagagagagagagagagagagagactgactgaatgtgggaggaagctgcagagctagcgagctcaggagtgatcaggggagaagttctggttagggaacccggcccagactttagccatggggcagtggcgacaccttctggcttatccctgagcaaacaaacaaacaaacaaaaaactccccaaaaacctattgtgtattttccacagagaacatgtacgtgtgttttctattagactttccagaaactcataaatgattgtagaacccatcgtgctaatagaaagtacggcataaatgctgacggaagctattaatgctgattgtagtttatgtggccaaatgaatcaggctgaaatctgtgagtttttttatggttactttataacaggttatttttaagtatcaggccatagattaggtttaatgcggatgctcacacacttagaatgagctggttaagagagattctaactttatcagtcatccgttccagcgtttagacctagagatttttctcaattctccctcccccaaaacacttaggctgaagtacattcaccacattttgtcttgtttcatcctcaaatagccacatcttttacataagagccattcacaaacttaaaaactgcctctgtgccactgcaatgctagactgaaataattactggatttggtgattctgtgaatatcctacaaattctcttccagttgcccattcttttatttgttaaacaggcatctattcggtgcccactgtgggccaactttgtgcccctttccccacatggattgctgggtgaggaccctgatggggaaggtgggaagtgttgagtatatttaaggaaatacacatggtagtcattcattgagtattcatcggatcgtgaactgatttgatcaccatttcctaaatgacacactcttgtttaattcagcactacatacatattaaatagtggattatattaaatgttaatatacgcaagtcaagagcacagatcatgggaccagctgcctgggctggggtcctgaccctgacacatactagcttgggcaggttgcttaaccggtgcttgtttccttctctgcaaagtggagatcataacatggcataccttagagggttgctgggagcaataattgagtcatcacctgcagagggcttagtacagtgcccggcatgctgtaagcagttgttatgtacaatgtgtatgtgcaacgcatgatgatgctgatgtatgagaaacaaagcatacaaaaaaagcaacaaaaaattcttagagctgcaagaaaaaagtggctcttgcctctggctctgctcagtaaacatcgtgcttgactcatcctctgccctgaaatgctgacatgaacagggatattcagctgttcctttcattctgactctacagccagaaccacagtcccccagccgaaagccttcatcataacagatgtgaaatggggcaaccttaaaggttgggggtgactgatacttacacagaattccccagatatgctacaagtacacctggacctccctcccccttgctcagagcagttccctggataccctaatgtgccccagcaaaaattacagtttgtggggagaagctacccattggatgtttgagttgcacagcttttactacatgagtcttgcatctcctaaagtttgaagtgtgtagcaaattaaatgtgcaattttatacttctgtttcctgaaatctagtagggggtaaatgactcagatttttccagcaccaaaggagaatttaaaatagtgtgtcctttttggcaatggctaggacaggtattttcaccagagagagaaaaaatatcaccttaacttgaaagtgaatatataagaattgaatatacaagaattcagtctccttttatttgttactagtagaagacagagcccatatatatatatattttcagggtagcaatgtgccctatcaaaaatactcatcttcctagattcccagaatttcagctacagaaggccaaataaccaagttctggctaaagagatatcggtagaaattaatcaatgggcttctgggaaagataagatagatgcggctggcattgtctggaatgcggatgtgatgtttgggggtggagcaaccatcctgtgaaacaagaatgaaagtcacacacgaaagatggagaattaggagctctaagcagcagctcaattctcgacttctttcagcaactacatttgcctggaactctctactctctggacttcttgtcatgtgagaaaagcaaattcctcttaagaagtaaacatttatcaagagtgcttagaacagggcatggttcatagtaaaatgctatataggttttgctaataaaatacatgtttgctttagccactgtagtcaggcttctattacaaacagccaaacacaacatttgccaatatacataggtattgccaacatgccaacatgtcattattccgctttttttttttttttttgagatagagtctcgctctgtcacccaggctggaatgcaatggtgcgatctcagctcactgcaaactccatctccctggctcaagcaattcttctgcctcagcctcccaagtagctgggactacaggcgcgtgccaccacgcctggctaatttttgtatttttagtagagactgggtttcaccatattggccaggctggtcttgaactcctgacctcgtgatccgcctgccctggcctcccaaagtgctgagattacaggcatgagccgtcgcgctcagcctcattatttcacttttattctagcaccttgcacagcgtatggtactgaataagtatttgttgaaagaataagccgttcagtggggtttgaggaaagatgaaggaccctaaaatcatgtgactctatttatatacttatgtaataagctttaactctgtagaggaacaacagttccctttctttgtataatagtagcccttggtcttttgaggatagatgaagggattcaattagtttggcctgagataccctcccacagagtcccagccactttgttatcagagccaagagagaagcataggttagcatcaacctctctgccaaacgactcaggtaggactgaggcagtttcagacctgggcaaaatgttgagtaaaactcatcttagggtccccacaatggaaacagaacatggataactatcattgcaaacatcagtgggcatgagaccatcagagttagagctgagtgcaggaggtctgagaaatcacgtggctcaaccctcccctccccagaatgttctggaagggaagaggttctagacactagcacagagaaacatatatacacacacacacatacacacacacacacacatatatacatacatatacatatatatatatatattttattttttttattttttttgaaatggagtctcgctctgtcacccaggctggagtgcagtggtgtgatctcggctcactgcaagctccacctcctgggttcatggcattctcctgcctcagcctcccgagtagctgggactacaggcacccgccaccacacccggctaaattttttttttttttgtatttttagtagagatggggtttcaccatattggccaggctggtcttgaactcctgaccttgtgatccgcccccctcggcttcccaaagtgctgggattataggcatgagccaccgcgcccggccagagaaacgtattttatttaccttgatccagatcattaaatgctttgtccaccaggggtcttagaaaaataatttgacctctggctgctagctgaaaaaagtctagaatttagccttctgtgttttctcttttgactcttggtgaagtatcacttttaacaccaaatagaatttcccttgaatgtggttataaaaataatggtgaaaagaaaaatcccacttcagcgaagcccgccagcacactggccatcctagtgaggagagctgctcaggttcttgcattcttttattgattggttctaagtgagattattcaccatgaagcttgatatcatataacagaggctacaaaagcattgtatgttctcacgtcaaagacaatgctagtcacagaacatcataggatttaaatggggactgggaagttttaaataaatacagtcagagcataggggagtctgcaacatggggacagatttaaaaggtgaggttccacagcggggacaggaagtggctggaggacgtgcccgtggctctgatgaggccccgtcatcatctcccaagcaaaggcatagacaaggtagaggtgtgttgaagtgtttgtatacttttttttctctcatttaacaaatattgatggaccatctgccctgggtcagatgctgagctggggtctggggtgacaatgatgaaggaggcacacccagcatgcttcctcacagagacagctgctcagaaccctgtttctcacagcacagccctggaccaacagtgtccgaatcgcctgggagctctcaggccttgccccagatccactacctcaatatctgcttcgtaacaagaccctgtgggaaaccaggatatgccacccccaaaataggaaggattgttgagatgaagacaattcagaagaaacagaggcagtaaagctctctgccctccctctatttgtctaaaagcaggacgtagatttacaaagacaaaacgtatcttgcctccccccttctaccagggagaaccactgaaaacaacttaagacgcttatgctcctggagatggccctgcaggaatctacattgaacaagctttgctaactggcctttatctgccattcatttgctatcccccgaagttgctgcccctagagactcaaagtgttttttcccttgtcacatctctaaaagtttactgtcctttgatgaggatgctgtgaaactagaattcaaagccatctctttgagaactcctcattatagaaaatatacatgttaataaacttctgcttgtttttctcttgttaatctgtcttttgttacaggggtcccttccaactaagaacctatgggggttattcttcctctaaaacccccacgggattcaaatgtattcgcaaggtagaaaatggtctggctaacaagaggaatgaaaagaagtgctgctttatgcttaagccttaagtctgtgcctgtcttaactcatgaggctactccggctcagcctggaaacaagcttgagatggggtggagtgccttcctgcaagacggcgctggagcaggatttgaaagaaagcctggggttttaaagccaaagttccatgtagcaactttttcccaacaaattaccctctctaaactgctgataaagtcagaataccagactagatttaatccctggttttagttcttatgtctttgcaacactagttggtagcaaaagatgtttaaaagctgagaaatgctgaagcttttgctagaaggttcagtgcaccacctggatttcacatcttgtcattttcagccccagctctaccaaaaatgagggaatctgttctacaggttaacttatccagagatattctcccctaaaggtcagcagaaacttggaaaaagtttcctcaaagctacgtcctaaccacagacaaggggttatgaatgtagtaattgtataaaccaactgtgatactttcaacctacacacacacaatgaaatgtagacacacacacccatggacacactattgtacttctgtggtctgcatatcctgtgcttagtgggatattgtgtcccatcatgaatatattgtgtcccatcatgaatataattttgcatgtaagcactttcttttagattaattgaaatgagcctgtctaaggaggtatgtgatggcctttgccagtacataagaacatcagaacacacacgaagtgcataagtgtgtgtgtgtgtgtgtgtgtgtgtgtagagagagagagattgagaaacgtatttggttcctatgtgtagactgcacaaagacaagaggtgttggttgcataggatgaggtaacggtaggaagaggtgaaagaacatttaactcatgtgcaaatcagttatttaacgttcctttattccccaggtcttgatctgcatccaggccaggccaggagaactcattctggtcagacagcgggaaattccaccacatggaatggtgttggtggtctccgctctactccagtccaggagcccacacagcaaaattccactaatgaatgcgcccacccacgcagggcccagctctccccacccccttctccccatgcctgccccattcaacaggccacgccaccaccaaccgccttccttacaactgcccaaggattcgtttcaggagcaagatttgttaaattataaattggaagcatccacctcaataatgaaccaaatcaaagaccctctggaggaatccctcaggcagctcatgggagggaccagaggaagcatttgcccactcctctccctcctgccctcagccccaaggaccctccatgagggaggagacgaggacatgcaagtgcagagcccaccagacctccgaggtgggtcccaccgagcctaggttatttgtttttccttacaagaatgctagtcaaagcaaaactttaacccaacaaaccaacaaacaaaatacccctagttggctatttgcacacaggggttgccaaggaaggcagcctgaagggtccctttgtgaccagaggcgtttttgaaaggagacagcaatggctgctttatgaggaagtggtgagacggtcacatgttatccgcattgctgtggaggtcggcctgaccacccaggagccttcaccaagatggcctgataacagcccaccgtggggctcccaggcctctgcagcggtcttcctgggacccaactgtcctccaaaagaactgcttccaacagagtagacatggagccccacggccacctaagtgactctgtttctgagcatgctacagggtaattaggtttcacattcctgctgctttttacacacggccttagctttctcatcaggcctgtggcagagcacaaggcagaatgagaaggggggtgccgcatccatcccctggatggccaggccctccagacagggccactgtgacacgggggctgggggctgggagggaggaaggggagaaggcatgaagcgccttatgattgaagtggcttggaataataaatatacacactcttttttaaacgtggctcaccacatcctgggaatctggaaaaaatgccccacttcactgtccctcaccctcctccccacctaccccccagcagcagtggctttcatgacgcctgggggaaagcacagggcctttgataataaggggcttgttagttctaggctaacagccctcccaggccgctctgaatcctttcaagcacttttttattttaggtcaaggaagttcgtaaatgtaaagactcgagattgtagaaggagaagaggaaagggagaaagaagcatttgggggtagttgtcattgggaggggcagccagggacctcctatggtagatccgtcaggcctggtggacatgcccttcccttggtgtgggggacagataatggaaggtggctttgagccttgaagaagacctagccttgtttgaaccgtctaagctttggcttagataaaactgaatctttgtataggaagaccctttcgaatccacaggccttgaataaatcacatcagctggctctggcgacgattcctctgcctgccagaagagggcagcacatgcttcctcattacagggaaagctgggctgcccagtccaaagggtggacactaggtatggaggcggggggagcactgtgaaattaatagcagcagcagcaacagcagcagcaatagctatcacatattggtgcctactgtgtgccaggaactgtcctaagtgatttatatgcattaattcatctaattaacatgacaaatcttcaagagagggtgctattacaatctccatattaccgttgaggaggctgaggcatactgaaattaacagaacttgctattgtagccacggactgcctaagattgaggtcagcaaattacagtccaaggactaaatccagttcactgcctactttcatgctgccctcaagctaagtattgttttgtgttttacatttttgcatggttggaaaaaagtcaaaagaagaataatatttcatgaagtgagaatgatgtgaaattcaaatttcagtgtccacgaatgatgttttattggaacacagccctatttatttgtttacatattatctgtggctgctttatgattcctgcagcagaattgagcagagtctggtagaggctatgtagcttgcaaagcctaaactatttactatctgaccctatatagagaaagtttgccaagccctgacttatgaggaagagctacctgtttccaggcaagagggacagagaacagagttgctatttactggaaatggagctagtatcgctatcccagggcaatttagaagcaatgttgaacttgattcactttttttccaacagggcagctcaaggtcaagcaaaaggagggtctgacatgtcactgaatagcctcaaggaagtaataaaaggttagatctggaaaggactgtgaaagtccactattatgtctcaagtctaaggtgcacatttttttcactctttaacatctgtgaaatcaggcaatgtcttacaatcaaaatatgagaggttaagtgaaaacactttgtttaagtgatagcattttgttgttgtttcttagaggtttgtttgtttgtttgtttttgagatggaatcttgctctgtcacccaggctaaagtgcagtggcatgatcttggctcactgcgacctctgcctcccgggtttaagtggttctcctgcctcagcctcccaactagctggaattacaggtgtgcgccaccatgctcggctaatttttttgtagttttagtagagactgggttttgccatttggccaggctgatctcaaactcctgacctcaagtgatctgcccacctcggcctcccaaagtgctgggattataggtgtgtgccactgtgcccagccagtatttaaaataatagtgtcgtacaatcaatgacaccttagattaggcagttcctgcctccaaagatccagcctctttttggtcctttctgttgatgggatactcacttcttttgctggcagtccattctacagatttaattttaaagtttcttttcttttttctttttagacggagtctcattctgtcgccaggctggagtgcagtggcaccatctcggttcactgcaacctacaactccctggttcaagtaattctcctgcctcaacctctcaagtagatgggatataggcacatgcccccacgaccagctaatttttgtatttttagtagagacggggtttcaccatgttggccaggacggtctcaaactcgtgacctcgtgatcggcctgccttggcctcccaaagtgctgggattacaggcgtgagccaccatgcccggcctaattgtaaactttctaatgttgagctgaagtgtgtaagcctaaattttctatacatcaaatgaggatgatcttgcttaatacgtttactttaagagtcttaagatcttattaaaagggagcgaagggaaggaagcactgtgacccccggggtagggaggaccagagccggctgcaggaatcagtctgtcggtgtggtcacaccaggcagtctgcaagatgggaggacagggatgagttgttggggacacaaaccatgaaaacctggaaggaaaagaaagaccgccagtgatacagatgagttctttttctagcagcatcagccaggagcatgacccactgcaggtggcacctcttagaaggagaagacaggagcaatttgaagattcgggcctgaatggaacaagaagacaaggaaagagcgaggaatgcacctgtggctggcttgcccctgctgccttatatgagggctctaggagatgaggaagggaaatgagagaggcaggatgacagtcattgatattgtgttaataagaaccacaatgtcctccttcaatcacgttcccattcagtgggaatgatcatccaaattctgagataaactcactgaggttcctagaataacccgagagtcttcttccattctatgtggcagggacaatcaatttttccagaataagcccagggagcttccaggttccagaaagaggagcctctgatgtgagccttagggaggtggaaaccttggcctttatttggaaacagaaccaagactgctcagggacctgtgtggctaatggccacttttttgttccagcaacaaattgggaaccaggaggtggtgggaactagggtacactccctcgccctctggtaaccacgtttgagcttggattggagagaaaggagaagcagagggcttagccctaaccaggtgcttttcatctggggacatgtgtcctggatttcctgggacagtaccaatttcttataatttgattattttcaatgaaggcaatttgttaggcatctgattttcagtttggaaaacatggccactgcagttacaactgatgaagggcaatgcaatctgagcacatgcccagcacgtcacagataccaaggaaggtttttagggctttctttcggaagttagaagcaccttattaggacaagtattttaggaagagtatgttaggacatctcagagtcttccataaaaagagaactaggtgcagccttgcgagtgaaaggggtacatctttgcacatctagtgcaggagcccattcatcttgatgaaaatagataagcccagacaggctgttctgtgtcccatgtgctgggtggacagagaggggcagggaggttggcgacacacgcctgaggctgcagggaggtctcctgagtcttccagagaagatggagagaaaggaagaaagtgagtttcaggtgaagagagaacacagggattgtgagatcgggaggagcacagctcacaggtgggggaagatggagaggagtcagagcagcaggaagtcagcagggcctggagtctacagcagcctgaaagagaagtcacaggaggggagagccaaagaaaatggaaaccacagctcctccgtgcctgcggctcacagcaggaatatttgttattcttctgggaggctggtttgtttttatcttctaggaggaccgagctgcagctgaccaggggccctgttttgctttgtctgctcacaagtttagagccaaatttgtggtctaccttctgtgtggcgcacgaaggccccggggctgccctgactgttttagctcacccagggctccatttgatggttgtctccttgtttttctttctcacctcctcttggcctttgttggtttgccgtgctttatgcatccctgggagtagctataaagcctttctggaacaagtggagtataaattttaaaatagaaagaaggccccccaagacagaggaatacagaggtggaaataagagagaaaagtggacttgaagggggaagaaaagagggaattcaaaggaagccttgaaagactaaaaccatccagattgggcaaaacaccacttagtgcaggtcgcctgggaggcctgagagagcttaagccccaagactgcatgtgatacagatgagatactattgcccctggggcttttcagacctctcactaggggaaagggagtcctgtggaagtgggctgcgcaaaaggaggttggatggaaggtggtcagcgtgaatagagcaggagaaatactgaatttttgtcttaggctacaggcataggcatgcctacttcctctccagctaaaaagaaaaggggcaaaagcacatgagaatatgacactggcaccaaaaacaaggatggtaattcttggtaggacattaactgtatctgagggaaacatgatagacctggaagaaattttaaaaaggggtaggagacttttcaaattagttaatcaaaatagagcattcaagatgcacattagatccatttgttaattacctgccatatgcgatggggacagaacatgaaataaatcatgtgtattgctaggattgaagcataaggaaagagagattgtggaaaataaagtgaaatatagcactttctgcctagattatgataagtaactaaaatgaatttcttgaaaaccaagagatttgcagggatttttagagtctgttcaaatggcagattgagggtaagaaatgcaaaatgtaagacagatattcagagggagaagtccacatcctcttaggaatgacagagagtgggggacatgttaaagtaggtgtcaaagaaacccctttagggaagagacaaacccaaggagccaaaggggtgttccagtggcaggcggggaggggtgtttcacagcgacgcttgctagaggtggaggcactggcttgcagaaggtggaggcctgggcccttgctgaactccaccatgtgccaggcaggctgggtagagagcatgattaagggggaggacagacctaactgcttgctaattacagggatgctgcaggatgtgccaaaggggcatggatgacactgtgccctccctcaagccttctacttcagcactctatgaacctccaggtctaaacccagggcataacttctccctgcaagattgaaaaagtgaatgtggggctcagaggaggaacccctccagccaaatctaaatgcagtgctgctttctcccatctcaaagatgctctttcgcaggaccacgagcactcttcccatgtgggttcctgatccagttccctatcatcacccactggtcctcccctttctaagggagcagggtttgtgcttcctccatcagactgagctctctctggttgtgtagaatctgagtaatgggtggattccacatgagaaaagcagacagaaaaggatatccaagaacactttcagggagctgcacatagcaggcaaaagtctcccaggaccttctctgcagcattttataacacagatcactcttttaaaacaacaacaacaacaataaagcttgctttcccatctttatgccctccccactacccccgatttcctccatcctccctggctagtccttctttctcttcctccttgactcctctccctctgtcatcccatctatgtgattgatccttgggcatcgtcttaatcatctaaagatgtataacccctcaaactgcatttttataccagaactctctgctaaggtacaattgtctacccgagataactgctcagaacaacggctgactttttttttttttttttttttttttgagatggagtttcactcttgttgcccatgctggagtgcaatgacgtgatctcggctcactgcaacctccgcctcccgggttcaagtgattctcctgcctcggcctcctgagtagctgggattacaggtgcttgtcaccataccctgctaatttttgtatttttagtagagatggggttttgtcatgttggtcaggctggtctcgaactcccaacctccggtcatctgcctgccttggcctcccaaagtgctgggattacaggggtcagacaccatgcctggccccagcagctgactttgaacgtggtagtgggcattattccaagcacacttatgaggtatacacagttattacccccatttcacagatgaggaaactgaggcattacagagttgaagtaacctgtgccatgttacaaggacaagaggcaaagctggtgtctgaactctgaactctaaagtagttggctttagagtctgcaagttgagccatacacagtcacctgcctctctgcataggaaacacagcatgtttagaaacaccgtccttatccttctccccaaaaccaggcgtgtgggtgagagatcttagagcacaagaaaacgaagcaacttccccaagtagcacctgacttaatgtgggatcttgccaccgagtcatgagaaaatccagtctacatttaagtgaagtgaagagcaggttggaaagagtgagaggagggggcatggaggcagtatctggttactgcagaccaaggggacctggatctagaaattacagaggaggggtgagtacagtgataggcctaaacacggagcacagaatcgtccctcagggaacaaaaaaaaatgcaaggctgctgaggtatgagagttgggccaggccactgacgctccttgatgacactttggagaggaggaccatgcaccaacaaagtttaaaaagtagaaaatagactgaatgggtgggagatttggaagagctaactgagggggaagcaagagctgaagcagcagtttctgatgtcattattcatcttagtcccatttttgtgctaatagcaataatcagaataatcaaatttaacagttacgaggccagacactgcgctaagggttttacatgcgctgagttataaaatagatgaacctgcattacaaaccttggtgatattattaattaccttattgccagataaagaaactgaatgtaaagtccattttacagatgcagagccagaggctcagaaagaataagcctcttgggtaaagttgtgcagctagaagtgctgggattcaaacccaggccgggaattgcacatgtacttgttttacagctccctgtagattgttagttcatggagggcaatgactttg

SEQ ID NO: 204 - DNA, 32327 bp, Homo sapiens
cgtgcgtcacagaatggcctcggacacccaggcagtccctgacgtgtcggggaggagccgggcgcggaggtacgctgagtggagctcggggctgcgtaggggagctgagccgagcggctgggcgggcctggccgggccggcggaggggagacgtcggttgagcggcggcgaacatgcgcttttgacacattggaggtgagcctgcagcgcggggccgctccctaaggggctgcgctgggccggcggcgccgaggcctgcccttggggagccttcccggcccggggccgtgtctgaggctccgccggggcgggccgggccgggttccggggcggccagcctgggggcaactgttccaaccgctctaactgtcccctcccttccctggtccgatgtgtggccccccaggggcgcctgcaagggaacgattccggtggcctccggaagatgtgccccgttccgggtagggtgagggctggcggtgacggaggccgggacgtggcaccgtgggctggggcgctggcggcgcaaggagtggcccagtcggaggtggcagcggcgcgcccagcccgcctcctcctaccccctcttcgaaattccttcatttgcgagggtggcttggagcggggttgcattttgatctctcagtgcctctctcccatggggggcgagagcgcgagcagcccacgttgggctcggattggcattctcctgactcccgcccggaactgctaatcatcctccccctggagttcggcaaagtgtcaccaacgggctcgggttacttgtgctcgactcttttcttgctgtaagccatgagatgaccctttaagttttgcaaaggaggtgagagttctgtcaccactgattattaccttctatttacgtagcacctttacacgtttcagagcactcttcttcctatctttttctaaccgcatcaccttgtggttgcaactgattatgttatcgccatttcgatgggtaaatggagctgggatgggggtaattatttatacttaggttcaaccaactggtgagtggtttagcttggatcataatttacatttctaggctcggagttctggtttcttttcgtgggatttttatacccttctcagctacaaaacaaggcagaaaatgtgacttgccaaagatatgccagaagctggtagattacttactcaattatttttgagaaaactcacctaggataaaaacggctgctcagtcatgagaaaaatcttcctgtgaagcttgttcaggagttgctggttaattgctttgctaaatcgtgaagttgatgggcacagtgcagcgttaagtcatgggctgaagagaagtaaagggaaaccaagtgaagtatttcttctgaattattattaaaattattgttatttaaaattagagtgcgtgagaaacaaaacctttggccagccctggttagaggttgacttgatccagatagaagttgctaaatcttctgaagctgtagttcttttgatttttttaaattaaataaattgaagttggataaagagcttaaaataagtaggaaccttagtaaaacttagatcttgctttcatgacatctgcaaaacaacttatttttgttttcattttaaaccatgctgggataaatttggttactaaagcttaaaattacttctgacgtaagtttctgagcactccataaagtaaaaaagaagtctgatagaatcaaagagagaccgtgtttatgatcaactttgaagagttaaaaattctgtaaatgtcacctttgagagtagtagaatttcagtaaaaaggcatatattgccaacagtgagttctgaaagaactcttctaacgtcagtccattttagaactgttaaccagaaacaatatcattgaaaatagattttcttaccattgtacaaagaataatttccttgtaaataaaaggcattttggacaggctgttttaaactcaaatgagttgattgttgctagatttctgaaggtcatacacagtatgataatgctttacgtaaaaattgtcatgcttttgagactgtgtccgtattgagatctggtattaaagaaagatggggtgggggcgggcagagaataataattttttttttctttgatggagtctccctctgttgcccaggctggagtgcagtggcacaatctcggctcactgcaacctccacctcctggattcaagcgattctcctgcctcagcctcctgagtagctgggattacaggtgcgcaccacgatgccctgctaatttttgtatatttagtagagacagggtttcaccatgttggtcaggctggtctcgaactcctcacctcgtgatccgcctgcctcagcctcacaaagtgctgggattacaggcgtgagccaccgtgccctgccaataatacataattatctatcttcattctagcttcagaaaattgtggatgtaccattagagcattgttttagcagtatgttttctatattagctaactttctatagcctgaatatctccagttacatagtttgaaataagtgaacacatcctcccagtgtaacttgaagcaaactgaacagactgtataacagcccctgaaactgtcgtttgagtatctgcagtggtagcaaattttattatttgtaaataatctgatttttatttttatttttttggaggcagggtctcattttgtcacccaggctggagtgcagtggagtgattacagcttactgcagcctcaacttcctggactcaagcgatcctcccaccacagtctcacgagtagctgggaccacaggtgcatgccaccacacccagctcatttttgtatttttgttagagatggggtttcagcatgttgtccaggctggccttgaagttccaggctcaactgacattcccacctcagccttccaagtgctgggattaatatgcgcgagccactgtgcctggccagaatctgatttttaaaaagagtaaatctgatgggtaaaagtagggcaatagagctggataataccagttaggaagcaataaagatgaggtgtgaccacaaagtaagaagtttttgctttgttctttttttttttttttgaaacggagtctctctctgtcacccaggctggagtggagtgcggtcgcgcgctctcggctcactgcaagttctgcctcccgggttcacgccattctcctgcctcagcctcccgagtagctgggactgcaggtgcccaccaccacgcccagctagttttttgtgtttttagtagagacggggtttcaccatgttagcaggatagtctcaatctcctgacctcgtgatccgcccgcctcggcctcccaaagtgctgggattacaggtgtgagccactgtgcccggcctttttttttttcttttatttgagatggaatctcacccttttgcccaggctggagtgcagtggccaatctcggctcactgcaacctcctcctcccgggtttgagcgattctcctgcctcagcctcctgagtagctgggattacaggtgccggccaccatacccagctaatttttttttttttttttcatattttcggtatagacgaggtttcaccatgttggccaggctggtcttgaactcctaacctcaagtgatccgcctgcctcagcctcccaaagtgctaggattataggcatgagccaccgcgcctggcctgctttgttcgcctgctttgttcttaatgtggctcataaaggctattccaaaaaagaagttttggaaatgtttttcagcaatggtgatatcactggaatatgcatatattcctgaaatgatcagttttaaagaatcatttgcatgttttaaattttgaagcctgtttactttgtggtcatacttgaaaggtctgctatcgaactaccaatttttaatagcttgatgaacatttaggtttttactatgtgccaggttctgtcctaagtactttacaaatattagctcacttcataagctcattctaatgattatccccattttacaggtgaggaaatggggcactgagtcattaagtcacttgcccaaggtcacccaagtagtgagtagatgcatcagtagcgagtctgaacttccaggtctgacttcagacttgggcagtttggcttcccggtctgggctcttaaccactatgctatgctgctcctatgacttattcttggttaaatgttttaaattgttttgatctggaagagatgatggtccttttagtaaatgatatccaacataggttataatactgttagaggggccaataagcgggttatgaaaatagcctattgattagaaaagttgtggtcaacattcaattcacatgagattcagcaagaaaataaagaatgtgaccaggcgcggtggctcatgcctgtaatcccagcactttgggaggccgaggagggcagatcacgaggtcaggagttcgagacagcctggccaacatggtgaaaccgtgtcctactaaaaatacaaaaattagccaggtatggtggtgggtgcttgtaatcccagctacttaggaggccgaggcaagagaattgcttgaacctgggagtcagaggttgcagtgaactaggattgtgccactgcactccagcctgggcaacagagtgagactccatctcaaaaaaaaaaaaaaaaaaagaatgtgtgtgaagtaaaataattttgctagaattacttgacactgaatgtaagtagttggacaaagaggatgcaagggctagaactagattctcaaaaagtttcatgcaaaaggctatttaaaaacctgagttatcaggggacactcatggaaaagttggtgttgtattaagaatatgtccctgtacaagaaccagaagtcagagacaaatggatactcgcaatacatccagaggggtaaacaatgctattcctcagggattactacttaactaggtgctcttcaaagcattaactgctagtatgtcctctgatactatataaatgggtcaaaaccaacaaaaaatacccccacatggaaatgttttgaagtggactcctgaataacatttagagattcaaaacaatcctaactcttttcgtagaagaattggccccacattcaaacaccttcaaataaatgttagatgccaaggaaggtatctaacagtcattaggaacttccataatgataccggttcatgggccacactactagcaatatcatcaaatgctgcacagtaacagaaagagtactgaaaactcaaaagaaaaatgatctgaccagtgaataaaatgttcagtacagaagcagcactaggcactcagccccagaaaggcagataggtaatctaggggcaatacaaagcataacaaaatatttaagggactgagatggctgccaaatcattataggctaaaaaggcaagaaataatcactttgggaagaccaaggctgagaggtattatcatcaaaggctacaaaaccagaggggacataaaaaaggagaatacaattttgttcgccaaatcctggaaccttccaagagagcagcacatgggactcagggcaaagctaagaccaaaaacaggaagttcatcgatggctataaagttatggaacttatcccagttgcttcaaataagataaaatcaatacattacaagttttagacttgaaatcattaacttacaaaatgctttatataaggatcaggactttcttctattgctttttttattttcctgagcttttaaatttctctttttcttagtgacagtagagtaacatgtcttcaccacaacctcaaatatatctagcttctcacttgtgctctatgctatctgttctatgggattccttatttttcttggtgtcatccgtctgaagcattctatgggcctgatggactaggcttcatcctgggacttttcattgcagccctaggttggagcccctatttcctgcatcccatgctgtccaggtcatggttttctcccttcttttgtacttgtctcaggaagtgtgtaggaggtagccctcctgacctttttttttaagtctttgtctagtaccttctgagttcttgtataagaaaaaatctcatttcctgaattgtctgtttcctctcagttcactaggtcctaaaattttcttattcatgctactgggttttcttacttgtcagatggctcttggttgtccatttatatttcagggccggataatgatgatttgaggtagctagtgtgcagtggttatctctaaggttcttcccaataaatcccatcaactccctattctttgatgtggagcctgtactgagcctatgtcagtgactgaatgtggctgcccatgtatcggattaataattttgtctaactgataatgataggttttctaatattgatttaatatatggtggtacattgtaaggtggaagtaaactacccgcacatctttttgcttactccattcctgaagtaggaattcagatgttaataaagtggtactttgaaagtcaagagggaatattgaaaggatgattataaatcagttcacatatttatttatttattttagagacagggtcttgctgtgttgcccaggctggagtgcagtggcacaatcatggctcactgcagcctcaaaatcatggcttactgcagcctcattgcttctgggctcaagcagtcctcctgcctcagcctccccatgtgttgggattacaggcatgagccaccgtgtccagcctcaattcaaatatttattgaacttccactgtgttctatgtttgatgatgtggagagatttaaccgttcattcctttaaaaagatttttttttttttttgctaaaccttcctgagtggcttgtgctagataaactccaagttctatgcatctccaggtttttatttatttactttttttttttttttttttttttagatttttagacggagtctcgctctgtcccccaggctggagtgcagtggcgcaatcttggctcactgcaagctccgcctcccgggttcacaccattctcctcccgagtaggtgggactacaggcgcctgccaccacgcccggctaattttttgtatttttagcagagatggggtttcaccgtgttagccaggatggtctcaatctcctgacctcgtgatccgcccgcctcggcctcccaaagtgctgggattacaggcatgagccaccacacctagcctattaatttacttttaaagctggtcttgagttcttgctgcctagtatggaataggttgaatcaattatggtttaattcagtaaatatcattgagtatccactattgtgcaggcattgggctgagacggaaataagtaagccagcctaacaggcaacacaaaggtgtaagcaaatgcattgccctgtggtaataatatcagtgaaagcatgtgtggggtacagaggtagcaaagaatgcaagagattttaatgctgtccagttgagggcaagaaaacctctctggaaaagatgacaattaggttttaaggataaatagtagttttcctatttaggggagccactccaggtagagaaaacctggagtagttttccatgcctgaaagagcctggtgtgttaagacagtttcgaacagtactgccagaatatagagtgggatgcctggggagggggtgctaggaagcagtaggcatgcctctagagtgggcctgacgatcagttgggagttgtaggtagccagtccaaatgttagttaattaaatcgctttttttctcctctctgaatgccttgggagagaagaaccaggatgagagagagagatcattgaagttggagattagtgggcttttggaaggaagctttggacttaaaagatgattaacaggaggtttttagagatttgataatagtaaattattgggaatgtggtgcctgattttctagtagggtcacctggcataaaatgttccaagcagatgttttgaagcagttgtatacctgggaagggcagcatgcatgcggtagcagcatctctgacaataagcttgtttctgtctcccgattcgcagaagaccacgtggccttaaaccaactgctgcaactctgtgtgcaggatgattctgtgggcccaagtcacccagcgcctatgctgcaaccaaaagtgcctcctgtcgctttgtatcaaaggacctttgtcatgatctcattcacaatattggtggtccctgagagtggagcagtggagtgattgacgtgcctgagtttgaagagagttaaccactggaatctctcatgttttattccctccaaaatgctgcagttcagtgttgtcccagattttatgcttgtgcttagatttctctgttctctaatttgttaagtttgtctttaatatttcacaggctttcttgatcatggatggtgaagatataccagatttttcaagtttaaaggaggaaactgcttattggaaggaactttccttgaagtataagcaaaggtaatgttggaaagcacactaaaagtaggggagggcatttggaatacaccgtgtcttgtttgtgcatttttctttttaacataaagctaaatttagaattgcagatttaggattctaggattgagattctacaaacagtcaccacatgggttgtatttaaatagtgtaaacatgccataagtctttatattgttcaaattattaaaatagtaggaaaactgtcatttatgatttcttctgattgttacctgttctatgctttttagtaggcggggccatctttggcccgttttgcatgcactgattctgcctcatcattttggtcatttggagattctgataagctgtctggggctccatagaacagactttacgttctcctcaggcaagcatgatcagtgtctggagccagcaaagctttgagggagggggagaagcttcaggggcatggaacgttttataaaatttcagttatttggttgggagaactttcaggcaacaaccttttaagcaacaaaacttgtctcaaatttcttttttaaaaatgggatcttgctaaataaaatattgatacattttcctattttggttaacagagtttactaagtcttatcaaaccttttactgccctttcattattatcaccgaagtcagttattctattgtgccagtggatatgaaaggtgtgtatctatggcagggttcttaatctttttctgtgtcatagatgtcttaatgggctggggtagcctgtggactcctcagcataatatttttaaatgcatagaataatagaattacaaagaaaatcaattatattgaaaaaagttatctaaatattaaactaatttatggcatagtaacatgtacttctctattaatgcattaaataaaaaaagatacagaagtgaatgtaataactacctaattttgaaatagtcatgaaaataaatatatttagagatacatgcaacgattctattgtgatgtgaaaatatgtgtgatttctgttgaatatggtagaaggaaatgccaaatttgttactttaatgaaagtaaaaatgcatttttctcgcatctgagttctgtggtggaagaagctaatggtattgagccacgtagccttacttttcataaatattgtaatcactgacttgtggctcctttttgggcttgtcgttttcattgaaccctgaatatatacagtaagagatgcaaaacagattgtctttagtatattttatgagagcattagcattcaagcaaaaattatcgaattgctctataatcacctccaagacaatccttgtggttcttagtgtaactcgtctttcccactttgtttctgattagcttccaggaagctcgggatgagctagttgaattccaggaaggaagcagagaattagaagcagagttggaggcacaattagtacaggctgaacaaagaaatagagacttgcaggctgataaccaaagactgaaatatgaagtggaggcattaaaggtaattgcagcagtagacgctggggtctaatgtgttgagttttattaaaatgagaaatatgtttttcaggtgcttaagagcagctggcgacaaaaaatagtttgaaaaaaacgcttaaagtgaatttttgaataaaatgttttctttcacggaaccaggggaaaaggtggtttagagtttaggagttcacttagaaactttgtagttgtcacttttctagctataatgttcctagctatattatattatagttcctataattttcaaaagctgcctgattatttgttttgacagataggttgcctcattctgcagtatgtttacaattatattgatagggaatatgcatttatttcattattgttcatagccctttcagttttggagtttagttagggttaaaaatttcccttctaaaaaggaattttcaggagcaaaaggattcacccctttctctgccctttaccatctactgtagccacatgcttgagggtatttagtgtctggggagtgggtgggttctgggaaggttggatgggcaggtgaaaggtagggaatgtgaactctgtgcttaccctgggccgcatttagcctgaaaatccagaggtttccttaacaagtttgcggattttgaggcaaggattttttatattagttcttttcagagagattgttattgggtttctttctgagaggagaatggttgacaaaatttaacatgagtttaggcacttagaatgaatgtgtcatttagttgtttttaaagtaattgttacaagagtgtgggtaaattccttgggttcccccccacccttttaacttgagttacctctttagtaaagagaactgtatattaatgacatgtactttcctatactgatgccctcaggagaagctagagcatcaatatgcacagagctataagcaggtctcagtgttagaagatgatttaagtcagactcgggccattaaggagcagttgcataagtatgtgagagagctggagcaggccaacgacgacctggagcgagccaaaaggtaaacgaatgactgcattttgttagaaaaaaaccaccttggtaattagtgattaaaatctttattaggctcttcccctagatcttagtcccagaacatttcctgttggtgtttcatgtcacctgtaactcatcggacggaagggaaccccaaatcctcatctcccagataacgcccttcaaagctttctctttcaatttttcttttttccttctttcatatactgtggttgatcctattggttttgttttgttttttgagacagggtctcacattgtcgcccagtctggagtgcagtggcatgatctcggctcactgcaacctctgcctcccagattcaagcgattcttgtgcctcagccttccaagtagctgggattataggcatgtgccaccacacccagctaatttttgtatttttagtagagacggggttttgccatgttggccaggctggtcttgaattcctgccatcaagtgatctgcccaccttggcctcccaaagtgctgggattataggcatgagccactgcacccagcctaggttttgtgtatttatttattttttaaactgtctcatgcattcccccatcttccctctgtgctcttaacacttccatacttcctgtaggtcctcatatcttatacctggattctgtagttatcctctagctgatatatctttatatttctgttcctttttattctcttttaatactgactgatgaattttcttaaaatgttgatttcagttcaaatttctgaacaacgtgcagtggcttgctatcactgttgccaaacttttatgcatgtgtaattagttgtttcttaaccattccaaacttaattcctattactttataattgtttcctggtatttccttccttaatatttatccagtgagtcttaagtgactgacatgatgctaaacttacagatgcggagctagtctggtcactacccttgggggtgacagatatgtacattcactatgttaataccctagtaaaaaaaagtgggcaagctgctgctccagggcatagaggaggcagcagccagattggttgcggggaggtgggcggggggggggcagtgggggaaccaatcagaggctgaagtgaagttacaaagtgacaccctatgcaaatgtctgagtggttgcagaaagcaaagggaatagcttctggtccttttcttacttaggtgtggaaagttccggttttccttttgatttagttctaggaagtcagtgtgaattggccttaggttccctgacttgggacttaatgttttaaacaaactcttacatatattacaagttttgaaaagttttctttctgaaaatgtgtaaacttgattgtattgtgttcaaaacacagtggagatataaatagtgtaacaaatagcctttctgtagggaacattaaggaatagatgggaatttaaaagaatgtattgtatatattgcccaactgatagagacactacgtgccagcagtggtcaggaaggggcaagatcatcttctttgattggggccaggctggctaggtcaggaaatgtcacgagataaactgacagtttccttttgtactatctgtttgcacatgttatttatttaattcatgtactctaatttttctttttagggcaacaatagtttcactggaagactttgaacaaaggctaaaccaggccattgaacgaaatgcatttttagaaagtgaacttgatgaaaaggaatctttgttggtctctgtacagaggttaaaggatgaagcaagaggtaaaatttataacttaaagaatacagttgacccttgaacaacatgggtttgaattgtgtgggcccacttatactctgattttttttcaaccaaatgtggattgaaaatacagtattcacggcattcaaaaccctgtatatggagggctgacttttcatatatacgggctgactgtgggacttcagtatgcgccaattttggtgtaggtgggggtcctggaaccaatccccatgtatactgagggacaactgtatttatcctcccttaccttactgtccctatgccagaagaagcttagagtcaactttttttggagacgaagtctcgtactttcacccaggctggagtgcaatggcacaatctcagctcactgcaaattccgcctcctgggttcaaacaattctcctgcctcagcctctcgagtagctgggattacaggcgcccgccaccacacccagctgatttttgtatttttagtagagacgggatttcaccatattggccaggctgatctcgaactcctgacctcgtgatccggccgccttggcctcccaaaatgctgggattacagacgtgagccaccgcgcctggccccatccagctaattaagaaaacattttttttgtggagacagtctcagtatgttggccaggctggttttgaacccttggccttaaatggtccttctggttctgtctcccaaaatgttgggattatgggtgtgagccactgtgcctggcttcttaatcattttaaagtgtacagtccagtagtgttaagtatagtcaaattgttgtgtaaacaaatttttagaactttttcatcttgcaaaactgaaactatacctattgaatagtgactacccattttcccttcccttcagcccctggcaaccacagttctattttctatgagttcagctactttagatacctcatataagggagattatacagtatttgtgactggtttattgcatttagcataatgtcctcaaggtttatccatgtgtagtatgtgacaaaatttccttcttttttaaggctgaatgatactccattgtatgtattcattttctttatctgttcatctgtggatggacatcgagttgctcccatctcttgctattgcgaatgataccgctgtgaacatgggtgtccaaatatctctttgagatcctgttttgaattcttttggatacatacccaaaagggggatgactttgttccttttttaacacaagcaaatattctgtaagttaaattgcataattggaaaagataacattaattttgggttaaaaactcgacattggctgggtgtggcggctcacgcctgtaattctagcactttgggaggctgaggcgggtggatcatttgaggttaggagttcgagaccagcctgaccaacatggtgaaaccccatctctactaaaaattcaaaaaaaaaaattagctgggtgtggtggcgggcacctgtaatcccagctacttgggaggctgaggcaggagaatcgcttgaacccaggaggtggaggttgcagtgagccgagattgcgtcactgcactctagcctgggcgacagagtgagactccgtctcaaaaaaaaaaaaaaacgctcaatatttgaaagcatgagaaaaatttaaaccgttctgaatacttcttttctaaaagtaaatatttcatagtgataatagttaatgccagcccatttaaaattacaaaaatgcacttagttgattttgcaataaccccaaaactacatcatttgaaaataaaagcaaataagttggtgaagaatatttacttttgtgtgaattgtactgtggactctgcactgtttctttttgcatataagcataagtaacttctctcaggttatagcatttttaaattctaaaagatcatttagacagtagttttgccatttttattcccctagaaatgaaagttatacttaaataggaaattcatttttgagaaatagtaatttaggaagaagacctttatgacattttagatgtcactttgcttgatatatttgctccctctagtgagtattcctgcccttgtttgcaatattttacagatttaaggcaagaactagcagttcgggaaagacaacaggaagtaactagaaagtcggctcctagctctccaactctagactgtgaaaagatggactccgccgtccaagcatcactttctttgccagctacccctgttggcaaaggaacggagaacacttttccttcaccgaaaggtttgtaatgtcttttctttttgaggcgatgtgttagatgatcagcttacgggggtttgttgctgaaggcggttgctaaggtttaaagagtaattttagtttaaaagttggtgaagtctagtgctatgtgaaatagaagaaggaattgttttcctaggccactaatatataggaaacagtgaaatgatggttacatttaagatgagatttttaaaagttaaaggtttttaaggaaagtttattttttgatgatagcaatagattttgtgattacagccgtatgtttaggtagaaaattttaaaaacacagaaaaagaaaataaaaatcatgttatcttaccacttacaggcacccaccattaacattttgagtttttttttctattgtgtgcttgtgtgtgtttgtgcacatctctttgtcacatgcaaatttggggatcatatttaaacacagttttatttcttccttttgccactttccatatcatgggagacctgaggcctttctacatagaatgtacagagaatcattaagttatctttcagactcatgtaagaccggcttggatggacatgcccattctgttacatgcttcaggagctgccattttcaaaagcattgttcggagtaattgatgattggcacatacagaatactcacattgccatgaaccagtgtgtttttttaaaatccggataagcagaaaaaccacctagtagccactagatagaaccttaaaatggaatcttaaagctctcaattgagatttgtttagattttgcagctcgtagttcatatttctgctactctcatccccccttgctttttttttccaccctatattgaagctgtcatcccaccctttttaaaatatagggttttatcttttagaatgctatgtgggcaactagtacagtgagctctctctgtctgtgctactcaatagtcaccagcccatgtggctatttaaatttatattaaaatgaaataaaatataaaattcagtttctttgtcacattaaccacatttcaagtgctcagtaacccttgagtaggtaattcaacttgtctttgccttgttacgagatgatatcagataaggtatgtgaaggtgctgtatggttgtaaggtgttactaattgcgctaggtttactgctgaggacaaagggcaggcaatagattattagcagtcatcaggagccctcacggtcagtttttcagaagagctgcttgtatatttgaagatttcacaattacacctgaggactaacaaagttttacttttatgttactgattagaattatgcagatctgaaaatcctttaattgaagacgaatcagaatagtgaaaagcctcaggtgcggtgacacccacaggtggtgcacatttttttttaatagcccgttagagttttcattcagggacttggggagtcaaaaggacatggagcctgctgtggcacggcatgaggtgtgccaaccctatggcagtaatatttgcttaatagatatgtttttaggctggaaccaatagcatgaattttcactggctaacctaaaagctgctgtgtactagatcactgcaatttcattacaagaaagcacagagttgtgagcagcagcaggtggtcagagaaatcggtaagatcttagagctgatctttctgaagtggtctgtctttaattgtattttaccttttacaatgtttgtttctctttctttctttctttctctttctttctttttctttcttcctttctttcttttcttttctttttcttctcttttttttttttttttttgacagagttttgctttttttgcccaggctagagtgcaatggtgcgatcttggctcattgcaacttccgcctcctgggttcaagtgattctcctgccttggcctcccaagtagctgggattacaggtgtgtgccaccacacccagctaattttgtatttttagtagaaatggggtttcaccatgttggtcaggccagtctcaaactcctgacctcaggtgatccacccacctcagcctcccaaagtgctgagagtacaggcatgagccaccatgcccagcctacaatgtttgtttctaaaaagcatttaaagcaacttaccataaaagcacagatttaataacacctaaaatgtaaaacttgaatagggaaaaatgagatctagaaatccctgccaagaacagtacagcggttttttatatcacgttgagcgcctgttatgtgtcatgtgttattctggatgctgggagcacagtggtaagacaaagcccctaccttcaatgagattatattcttgaggagaagaaggataataaacaacaaaaaagccacacaagtattttcgttgctgattagcactctgtggaaaacaaacataaaaaataatagctaacctttattgagtacttactacgtgcatttttaaagtacattaatttaaacttcacaacatctttatgatgaggtagttgttatttgccccctcttacatatgggtcacttacccagtggctgaactggatttgaatacagtagttcagctcaagagccgttaatcatgatgtcatattatctcttaaaaattaagaaatgtgcacgactgaaaaccttactgagtgtggaagaagatatgggtaaatatcatggtaaatactatgattctgaatgggaagacttaattttcttacaatatccattctccccaagtcaatctgtaatttcaacttctaataaaaatcctaataggatttaaaaaattgatatgttgatattaaaattattttggaatagtaaatgtgcaagaacagctgagaaaaatttgaaatgggctaataacaagagggatctttgccttttgagatctcaaaatatattttaacattataataaagtagcatacttctgatagaataggctaatagttcaatggaactgaaatatattcatatatttagggaatttagtttatagttatagtgctatttcagatgagatgagttttccctaaatgatactaggacaattggctctccatttggaggaaaaaatttagatatgtatcttatagacaactataatttctaggtgaattaaatgatctaaatgtaaaaaaatcagaaaaatactaggagaaagtatgggaaacattatgacattaagatggaaaagccaaaggttctcctaccgaaacacagtgtttacaagatgaatgtcacgctgagagatagaacatctataagagaaagggtgaacatccagaatgtatagagttcttacaaattgattacaggaaagacaaaccagtagagaaatgtacaaagactaaacagctgattttcagaagagattcaaatgactagttactatggaaatagaaactaaaaaacgtgactatcaaattgtcaaaaaaaaaaaagataatatctaatattatcaagggcaccaccgcatagattgctgatattagcacaggctttttagagagcattttggcagtgtctgttaaggtgaaaaaaatgggcatatgttctgacccagcagttctatttttaggaatctcttttccagaaatacttgtctagatgtttaagagtatatgtccttgtagcattacttataatggcgaaaaatttgatataatgtaaatatccaccaattggacagtggtttagcctatttatggtatctatactttatccatagtttgaagtagtttgttgatattgtattgagtgttacactactttgtaacatcaacaacaaaacccaaatgtaaagggaactgcaagtgtaatcactcagcttttatttttctctagctataccaaatggttttggtaccagtccactaactccctctgctaggatatcagcactaaacatcgtgggggatctcttacggaaagtaggggtaagtttcaattatttatcactaggtgtttccactgacaaggtattgaattatttcttaatttgaagtgagggaagaaagaaaggatactttcctgtggtaaaggctgtcatgaagctcagaagcaaaagcatccattgactagccaagtccagatgacacttcatgatgcccctgcagaagagcctgtaccttgaactctgaggttcccaccggggcattcttcctgttccccactcctgtttcaacagcacgatgcctctgtccttgtctagaatactttgtctaaggcctgctgtgtgtcttctaccaccctcatcctggtctttgctgctgtctaccgtcttcctggtcattcctttgttttgtgtttgtgggactttaacatttggctcatggcattactctctacttttagtcttgcccaccttatttccttggccacctcaacttcagtgccttctccttggtgtgagccttgtattccagaacagtttcgcttctgaaatattaaacccagccggacgcggtggctcacgcctgtaatcccagcactttgggaggctgaggcgggtggatcacctgaggtcaggagttcaagaccagcctggccaacatggtgaaaccctgtctctactaaaaatacaaaaattagtcggcatggtggcagatgcctgtaatcccagctacttgggaggctgaggcaagagaatcacttgaacccaggaggcggaggttgcagtgagccgagatcgagccactgcactccagcctgggcaacagacagcaagactccatctcaaaaaaaaaaaaaaaaaaaaaattaaacccgtttttctgcttaatcagtgtgttactgtgtaccatacctactctttaacctcatcaagagtattaccccattttttagtgtgtttgtttttatcagccatctcttgctttcacttcctttctattcatctgtgatctcacacatctcttactctgtcactgttgacttcatggtctctctggccacaaaggagatctgcagtctgaattactggaaacagttgcagaaccatgtggatttatgccactatcaagtcagcatttctagcattagctcccattactatttcccttagtgagttttacctctcctttcagtaatcaaccattgccatttcccactatctactacccccttcacttattttcgtgtgtgacactttctaaaaaatgtagaaattgcattatactttatctaaagcagatatgggaggccaagacacaggtcctatgtttgcctgtttcagctcatcataggggttattttctaaccatcagattaaacctgcatttttaaggttaaaatacaaagtaaagtgcacaggtcgttcctacagtacatagagtaatctttcttcactcccaagataaccattttaaaatcctctatgttggagtatttgtctttataacttgaaatcatgtgcttatttttctgtttatcttgatttactcaactttaagcaaagatatttttatttttattttttgttcttttaaaaaaattactttaacattcttgaacttttgtttctgaatgtattaggttatatctttttttttttttttttttttttgagaacggagtctcgctttgttgccaaggctggagtgcagcggcacgatctcagctcactgcaacctctgcctcccaggttcaagcgattctcctgcatcagcctcctgagtagctgggattacaggcacatgccaccacacctggctaatttttgtatttttagtagagacggggtttcaccatgttggccatgctggtcttgaacgcctgacttcaggtgatctgcctgccttggcctgccaaagtgctgggattacaggcatgagccaccatgtctggccagtattagactatatcttaactcgctgttctctccctttcttccccaccacactcccactccgctttccttttctgagccctctactagctgtgtgagctctctgttggttggttctaaaaatggaaaagtagtcaaacagcatttgtaacaatgcacatatatgtgttatttactgtgtaatcacagaggagatgctggactttcagatgggtctttatatttgtgccattcaacaaatgtgttttgagaattttgttctttaactgtaatttactcaaaatcatactgggtttttaaatatttcgtattgtagctgactgtacgctgctttcttttcctagcatttctgtttccccttctttcttttgagtagaagaaacctacacctttctttgctctcggatcttctagcttcttcttcacactctttgtgggatgccctgatgggcttcgagggctgctgcattgttgtcgccctcgaatttctctccattttactcttgggttagttctgcctgttcctcaccccacgttgttgtctgtctttgttccttgtttgttttgctttagtactttaatttattcagaagtggtgcatgaaagtttaatttggcatccttgtatggtttacacattcagctgacaatccgtcttctaagagttatcaaaataacgacctccaaaagtcatcaacactttgggtctgctggtgtccaccagcccttgttggcttttatgaatatttcatttatgcctctttacacgactttgtccactgacttgaactggaagcccttctccactcttgcatgccttcacagagaaaatcaaggccatttgttttaagcttctttgatttcttttctcatcttttgttattactctcctattattacctctatttgtagccattcctcctttttgtcccagtggtaaaagtgcaaattcctgtccgtggctaattttgtccatctgtgctttggatctcatttcttccaacccttaaatctttatttctcctgtatttcagccttttactatatatgcgttaatatttatgtataatgtttatgtattacacattatatgttatgtgttatacaggtatactttgatatttctgtattacatgttatccatataaatatatgtaatacttatgtggtacatattacatactttaaagcttcttgaaagcgtgtccccatttattgttagcattttgactgcatgcacacgccccagacactttagcctgggctctgtcccctgcttatgccgctaaaactgctcactggtgatctcagtgctgtcaaatcctgtggatgccgttctgtcctaattttacttgaagcattcaacactgaccgttttttttttttaatgccctcttttctctccttctctgatgctgtttcatggctgctcccaactttctttccattcctcttagtcatcttgttgggtcttcatctgctcaccctttcgatattggttttactcagagttctgtccttgattttctgatcttaatcacagccatagtttcatccacccctgggtgtggatgtctttcaaatcttaatctctagaccaccctttcccccctcaaaagacctggtgctcgtgcttggatgtctcactgatgtctcagacataagttgtgcctgccgtgtgatagatactcaatatggatttgaatgaatgcgtgtcttgaatataggaattgaatggctctcaatttctactgtgtgtgtgtgtgtgtgtgtagctttaataagctgctgaattattgctgaattatgcttattcagagtttgttttacaaggtcattacctctcttccttttttctgttgtcattttagtaggtcattgtacttttgtcataggaaagaaggagaagaaaaaagtttgtctgtttttgttgctgtttcttttttttgagacagagtctcactctgtcgcccaggctgtagtgcagtggtgctatcaaggctcacagcaatctctgcttcctgggttccagtgattcttgtgccttagcctcctgcgtagctgggattacaggtgcatgccaccacacccagctaatttttttattttttctttagtagagacagggttttaccatcttggccaggctggtctcgaactcatggcctcaagtgatccacctgccttggcctcctaaagtgctgggattacaggaatgagccactgcacccaaccattgttgctgtttctgaatagctgttattgaaatgtggggggaggaggtccaaatggattctcaaagtgaagtatatgttacctgtggatttaatttagctgtgcattcccagtcctttactgtcatggataatagacatgaattgtgtatatatatattttgccatggatagtatttttcttttcggagaaggaggggtttgatttgggcaaagtgtttatgggaaagagacagctggtgaagtgtgagtgtgtggaaatacatgagaaacgcctgatctctccatgtcatctgcgttggtagagccctgtgcttgccaggtgttgtggtgacaggtgcaaaacaagggtgcccaatttagaggtaaatgctaaaaggccagtgtcatttgcgggtgaattatttaattacagacaaagggtatcagttaaacattttacagagtgctgtcagaaataaaatagcttttaatttcatgtaaagtgttgtaaatgttctcatccattctcatgcagtagaaaaaatgaagaacctagagaaagaattggctgccgtaaaaaaaattctcaagtgatatttttgggttttttaatagtgcttgctcccaaaacacaccctgccccccaacaccaactaacagtctacagcttagaaacgagcaatggatagggtcaagagacctgggatctgctgttccacctcctgtaccacactttttttagttgtaaggggaagattatatgtatttccttcagtaacgctaagaggaggaaacaaaatattctgaggtcattagaaagggagcataagtattccccctttttattagaaagttgattgattatggctgaactaaccaccattatcaactgagatgagtaagttttgaggcttgaaatagaaatggtttgaaatgcaaatttttatgtgcagctactgttttgacaaccatatcattcctccttcttttttgtaggctttagaatccaaattagcagcttgcaggaattttgcaaaggaccaagcatcacgaaaatcctatatttcagggaatgttaactgtggggtgctgaatggcaatggcacaaagttctctcgatcagggcatacatctttcttcgacaaagggtaagtcctgaatgttttaagtgataattttttgagtagtaaagtgacaggttagtaagtgagcataatgaagccttgaaaaggtaaactcagcttgacaaaccttcccgaagcctgttatcattctaatcttaggtgacatgacgtctgttgttgtcctctagtccccatggagtctgttgccccaggaaccctgaatctgaggcttctgtcctgggaagcagactcttgaaaggcagcagtgtgaggctctggtgagtcaaaatgactgcgataaggtccctgttctccaggtgcttacaggctggcagacttggaaatatttttttggggtagaagacagcatcacaattaaatatatgcaaactctacaacagacatcccctgtgagaattttagagaaatataaagccctgaagtacttaggcactggatcaaatacagtttaggagatacaacttttgtataaagttaaggcttttttgaagattgaaataaaattgttttaaggttgaagcatccttaatgcaaaaaatttcagttagtatggaagtatatgaactaaaaagtcatggtttcctgccttcacactgtttctgcattccttacagttattccaaggcatgccaaatcatatttttatgcatctgctctaagttgtttgtaacacagttacgggattatactttaaatattgctttgcagtgtgcctatcatgacttctattgccattatctttccatgtcatgtatattattctacctcaatttacttatttatttttaaatactacatggtaatacgtggttgtatgagtatgccttaatataggtcactattaggacccgtggcctgggatgctcacggtgttgcctaaggtagttgttattgaaacagccaacaggcacccgtgatccttggctactgtctctgctttgagtcaaagaggtaattcttgcttgtttttctctgaaagcagagcaggtacaactctagaaacgctcacaatctctgaaagcagctgggattttctgccgtcctcaataattatggcacatgtgtaaaggagcagattcgacacacggtgcactctgaataggctcttatccttgcagtggagtgttttggttgatctctgtccctgattttaccctggagaatatacatttcattaaggattttgtattaaaagcacatcctaaaacatcactatacaaattagaactttattctttcttaaaaaatttgtttaaataatttttgttttcttttgaagagatgggggtctcactctgttgcctaggctgatctcaaactcctgggctcaagtgatcctcctgcctcagcctcccaaagtgctgggcttgccgccgcgcccagctgaaatcagaactttattctaaccattgggtttcctcgggtggagtaaacataaaattgattttcctcaggcttaggagtttcaggcagacttgcggcagcccttgtttttatagtggaatgataaatggaatgactggatggttttacatgagcgtagccatttcccctgaatgatatggagaacttttagggtagtcttcataaatgttggaagcagtgcctaattatttttccctacaacttataatgatcctctactagagtagttattagtttctccttggaatcgtatttcttgatgggccgcaggtgcctttcatgagagcaggtgtgaatcataaatggataggtcggacaggtgcctgtgcgtgtggaagccctgaagaacagtcacgaggagggaaggataacactgtctgttcagggtcgctactcctgcccgccacttgcctcccaagacagagcaccagggcagggattgccaagaggtgagcctgttctgagggagatgtggggaccttagggtgagctgaagccaggaacaggccttgggcacactgactgcacctctgccccttgagagcatccgagatgtaagtgtaggctttacttcctgagctgaacccggaaatgtgctgtgcttcccaatcggaacagttgcagatactgagttttggttttaaatggtagacattttacattgtgccttttctattaagaaatatgcttttgtgggctggctgttgtgtgagtgtttagcttatatgataagtggattgtgtatgcgcactgaaatattaacctactgttgctggagttgtctttctagttgctgtattcctgaggataactcttttgtgggttttgctgtgttttcactttcttgccgctttgcttcgattccggcttttggcctgtctggctttttacctctggcttttcttctgccaacctgttgaccagataaaaaccaagatgttgtgtagcagccgcaaaaggaagggcaggatattccacttcccaggtccattatacactctggcaggttaaaaacacaaaagcctgtctgtgtagaagtggagaagtatggcttgtagtttcagcatgagaaaagtgccccatttgaaaaagccctccactgcagaacctgcctgccctccctctcactcctgaggagtctgtagcaccgtggtgatggctcactagtgctgccagaaacctgcggcaggattgtttgggggagagacatcatcaaagtaggtttgtgtgtgtgtgcatgtgtgcgggtgtacatgtgttcaccttcccacccgctgaaacttcagatgcagtgaagccttctcacataaaacaatataccttaactgggcgtattgctctgtgggattcaaaagtattttgtaaattctggtcacttgagggcttcttggaatcaggtttttgtctagtctgtgagcacttctgccagttcctgaaacatgggctgccgtgcctgcttcccaggtgccgagctgtttccttcaaccatggtcaccctttgtctcaccatctgaaaggacacacatttcatgtggagtgtggtcgcttggagtctctcaaaaacactcttttttttcccataactttatgtagtttcttaggtaacatgtgctctatttttgtaagccactctgagttcttttgggctgtgtgtaggtgggcatggactaattttagggcgtgatgtggaaatagtattcgtattactgtttaatatgttctcctttcttttattaggcaagaaaaagtcatatttcccacgttgttcatgggtaactgaatttgtttgctgtgctctttttcattctttcttaatcctggtgtgtggtggaagacacattaacaatctggttttactaactgcatggggctgactcagctttaaccaacttacagcccatcagtgaactttcacggtcctgttcgacttgactgtatgccgttattagttcagctgtgagaaacaagaacaaattagttgcagtggtcctggggtggctgggagtagcatgccaggtggcacgcctgagatgggctagggcgctgtagtgttgatttcagagtctggcgatgggggtttgaggtcactgtcaggccctgggatcacctttgactgtcttcctgggactgggggtcttcccgttacccagttgcttctgttttctcaagtcaggcaccagtgtgagcattccctcacctctgcgctcacgcatggagtccccagttaaaatggaatggtacatggggacgtgtgtaagatctgccttacatttcagaactgctttgcagtttgcagagcctgggctgagaactggagcaggctggagctgctctgagcccacactcatccactgaaataggagactcaggtgtggcgtgtgcctgcctgcaggctcttctggatagcttgagcccaccctcctgccctctccagtgtcctgatccttgctgctttgacagagttaatgtttccatccttcatctcagctgctttggatttattgtcctgagtagcttctaagtgtgccttggctcttcccccttttcacttcttccactgacattttacaactgaccttagcactttttcttagctggattctctatatttcagcctccttaactagtctgtggtggtaagatcatgaaattttatagctctggaaccttttttttacatatatgattcccagatctgtatcttcaagcctgccccatcactcttccttcagtcctgtcttgtgcactgggacattgccctgtggctctttgctgctccctgaaactgaatctgttgaatatagagtctcttctcttgcaaatcttttccccatgcacagctttgcaggcctctgaaggacttcactagacctgtcatcccatctagaaggccagctttcttctctctctgttctttaactttctactttttgagtcaggagagaggcgctaggtgagaccctggtggattgatgttccctctctactccacccaccttcacattaagcgttccatttctgcccatgtagaaatttaccggttctctctttatagtctgggctgcaccacttacttttcccattagagccggcctgcattggagtgccgaagtggttgcttctgagggctgctaggtggcctctgaccaggaggagactagaaaagggtcctggcctgggcatctggaggcagctgtggccccgacttccccatcagtggctcactaggtgagcctaggctaatggctggaccttctcttgctttggttgtcttggcagtggaacagtgggatgaacctgttgttccttacggtgcacttgaaaatgccagaatcccatcctcaacctgcttgaggagccatctcctagttgctgcttttgtacacccccgtggcccaggtgccagattcttcttggcatccaatggtgctccctttctgctgggttccgggcactgtctgcagtacaggtttaggggcttgcctgccactgtgatgtgtgaggccaggaatctgaggttcacacgtgctgagagctgcaggcatttgtggggcctgcctggttgtccctgaggtttctaggagaagcaggtgtcagggactctgggactagccagacagatggagcctattatatgagggctaccgtggcaaataggatatggccttggccccagaagaggcacaggcctgtgaccttgggagagtgggaaggatgatttcaaacttgcaaatgtgttgaagctcaaaaatcagacctaacccagtgaggaaagagacaatctggctgtttgtcgtcgaagtaggacagtgtgcaacagggagaaatgacatttgtcagagcctttctcctggggctcttggtctctgtatgcgtggttggaatttaaactccacatatgtactctgagtttagtttctttagacatgaactttgtttcttccaagtaggcagggactatttgtcaagtctctgcatgcctgtttgtctgtgaggttatcctcaccccgtcagtgtacgaaacagctgtctctgcagggagtgtgtgtcggcattttttttttttaaggagaacctctctccatgagtctgtatttagctccctggagccgtctgatgagtaggtgggggcagtagtgggcaggtgtggtgcagtgtggccccttgtcgtagttggctttatctcccaaattgctagtgggacaaattttcctaggaagcgtttcaaggtggaaaggctgaagtggctcctgagagaggttccaggctgcacactccctccccctcttgctgcttcctgtggctgcgctgcatggtgcgtgagggggatgcttggggggctccctgcatcgctgggctctgggtgcgtgatggggacgctggggggctccctgtgtcgctgggctccgggtgctgggtcctggctgcaggctattgggttgggctgggctgtctgcacacgagtctgcgttgaaaagcctactcatctggcgttgcttgctaaacaatttttaaaaggttatttttctccaccttattaagatattcgtgtattaatacattatatttggaaaatgtaaggagatttggaaaatgattaaaaaaggataaagtagtaaacaaaattcacccacagcccagagggaagaaaagtaacgattcttaaattttctttttatgatatatatgatcctatgtacatatatgttggtgtgtgtatatatatatgtgtatgcgtatatataatgtatgtatatatacatttatttatacacactccccctctgtccctgctttgtggatttagctgcatggatagtaatgtctatctaaggggctatagtctagaatctagaatatatactatttgcttttttttctttcatatcattgaatctacagagtttggtaacctgcatctttttccacttagtgttagttacattctgaatattttcccatgctattaaaaaacttgtggaatgtgtttttaatggctgtgcaatatcttattgttcagttgtaccattatttatttaactagttccctattgccaggcatttagacctgctttatggggaaagaatcaggactgtggcttccgtggccagtgtgcggcagttgccaaacaggtcatgtggtcctggttccccaggattcccaaaggctcaattctctaaccagctggtgctttccaggcagccagtgccccttgggccatcaggaccctacagcctgcgaggaatagttttagaaagcagattaatttcctattgtgtgtgagtgattttaaatgagtttttcgtttcccctttcttcccttctgtgctctggttgctcccacagggcagtaaacggctttgaccccgctcctcctcctcctggtctgggctcctcgcgtccatcgtcagcgccgggtatgctgcctctcagtgtgtgagtgcctagcctccaggtgggggctcctgccctcctccaacaacccaggacacccacgcctcacccctcggtgcctgggcccagccccgtgcccctccgtctgcctccgcacggctggcagagggcaggctgcatgcagtggcggctactgggccctgcccagccccggaactctgcgcgatatcaatactggctattttctcttctcgccgtagtgccgttggtttcacatgattgcacttttgtgggtcgcaaggtgatacatacgtgtattacttggtcactggatgcagaagtacccattcatcacacctgccccatagcccccactctgctgtactgataggatttagttgtgttttaggacattgcaaatcttctagaagttctcccccaaatcaggtcaatgtgtgccctcctgagctcccacccaggcatctccagtgctcatgatcatgtgtcccccaactccacccctcacagtttgggcctgtttctggcaaagagtcaggaaggttactgaattagggaacattttctgcaccttctgattttacttaagcagctaccattccatggacttgcctcccagagcagcacaatgcccgtctgagccccacgtggcaggagcctctgggacggggcacacacaggcccagcctctgtgctgtctcctcctccgtgcgcctcagactcggggtgagggaggcgggcagcctctcgccagccttcccgtccttcagttcaacgacatctttggagtgtttttgttttctcttccaagggccgtcccgttgtgttaggaagggtgagtggctggttccagggtgggccggtgccagctccggggtggactgaacagcggcggctgtccctgtgcatcctttgattactctcatgctgcatttactgtttacatttgttttattgtacataggtttgtaaacattattgcctgagatatttgtatataacttgggctttgtagcttttatttattcagaacgcatacggcatgttaatgactctgatggtgtcctcctctgggcagctgtataggatcatcatgtggttacaaaaaatacttccctcaaaaaaattcttttaatgtggaaacaataaatttcacagaaaaaaaggattgacgttgcttta

SEQ ID NO: 205 - DNA, 156558 bp, Homo sapiens
attccacgttcacatgattattcttgtttattgaggtctctttattctccacgggtgcttttttcttcaagtaaacagagcaggcgcaaatatctataatgaataaatttattgtcttacaaaaatcattgtctagaaatatgggaatacaagaaaagatatttgcggtcaggtgtctggtggtcaacagccagtacagttcataaagggggaaaatccaagattccaaacccacaggacaaattcttcctaatagatgttaaagcttttaacccaaaaggtttgtgttttcaagcacattgcagaggatcaaggatttagaattaacactgattcattgtcactgaatgtctgtaataccactttgactagagaggtacatgatatgaagcacagtcaaaactgaatacattaaattgttatagaggcgaatgatatattcaacattgtcttagtactgtagtgtctaaggcactttccgtaatgtcagtttgcttaactaccaaccaaaaacaggatgctaagtgttcactgtaacactgtccaaagggaagggagaaggaaaaatgaaggagtcacacccactggcatgtcaacattcaggaagatggcatctgttctggaggctccataaacctcattgacaaacttggaacaagcctcggacacaaaaccaatattcccattttgggctcaaagcagcggctgaatttgcaaggtcagcatgagggcccggctggcgatggggaggggccttccaccagctcggcttaggggtccacggctgcttgctcctgacgtgaggagggcgccggcagagccaggcggttcgggagaccatctggaagtctacatgatccatggctgccacctggggcctcagctgcagtgtggccactatcccttctatgcacagaccagccctcgccaaggccagttcacatgagtagatgcgggacaccatcgactcgaggggcagggccccccttgggggatggacatggtaaccccaaatgggtgttgcttccgatccagcccacccctcctactctttccaaagcccctttcacagtttgctcactgaaatagcattgatcattatttgaaggaaatgagagagacaagtgcagtttagagtccacagtggtctaggagacttgatgtggctgaggagtcgggggccacgtgaacacagaactaggttacctgtctgtatgacagagagcatgcagagcgactgagtgacgaccacggcgctgccccaataacccagcgacccgcaaccaagggcctggagtttgttttaaaaagggtcttaccatgttttataaaatggtctcttgatgactatatggaaaatagatgcaatgatgaaacaatctgtttaatatatgtgtcctgtgtgtgtctatatataaaaaggggagcaattgtacctaagtctgaagcaggatacagtatgcataggctggagagccttaagacacagttgatctttcaggaaggaatcccgtagcttgccaatttccgaaatctgcaggaggccccgggtgcattcctaactgtcccactgtattgcctcctctggcttcctgcaactttactctgactggggtggctgcgtctcgttgacatcactggtcttactttctgtgtcatcgtcggagagctccagggaagctccttcaaggtgcagctggcgccggccagatcggctggaagagaagctgatggggccaccccgcctggagaacacaggaagcagatgtgtgtgggtaaacagacaggagcacatggctgtcaatatgttcaaccactcaatgccacggaaccttccccttgcaccccctcctcggacacacgaccttgtgggggtggcggtacgatggggaaggactgcgtgcttttctgcctctcccacaaccctgcctgcagagtacgcgaagcagggtccttggagaactggggaggacttgattcagcctaggactgtgtgatggaaatggtaaggaagacggattaaggccaagctctacctgctaaccagggaatcagccagatagcaaagtgggccacatagggactctgttgcatattctttgtttcggcgtttttataaccatttaaaaatgtagaaaccatgcttagtttgatggctgtataaaagcagggtatgcaccaaatctgcccattggccagatgtgctgaaacctccgccgacctggtcttctggggcagagacttcagctgtagctctctcacgctctgccctctcactggtacagagcagatccattgtggtgaggaggacggtgctgaggagggctgatggcaccaggtcccaggaggagctcctgccctgctttttaagagaggctgggagctcacttcactaatggatatctggacagggatggatgcctgacccagctccagcctggtgtggtggattagtgtggtcctctagtgactggcaatgaatagggccgcctcctcttttattctccccaaggacgactataaaggtcagaaatcttaaatgaagtggttcgggagaaagaatgggtcactgggtatggatctaagtaaacttcctctgaccagctgcaccccgagcctaagctaacccacaaagcagctgcctgtcagctcggggccgcatgcctgctcacctcagccggttcttcagggtgctgacctcgcggctcaggccctcgttggcctcggtggcatcatccagttcccgctggagtttacgccgagatgcgttggcacgcgtcgcttcttcttctgcttcctccagctggcgtttaagctgcttcatccgagcgttggccttctccatcttggggagggtacatgaaccaaaacaaaccaaactggtgaatccagtgtcggcctctctgtaccccgagcgtggcagtgtggggctctgcctgttacccttgtgagcacgcgtgtacacggatgtacacgcgtgcctgggggctggtcggaggctctgtaaccggcctgccgctctcagcaaagctagcatctacaaagcacactaggccaaaagaaatgaaaaagtactcaagactctgtttttaccagtgagttttctgcagaaaaatgacagcgtttactgtcttcacacacgtgacctaggggactgaaagggaattgctattcttgcaaaacgtggaagaaccagcaatgtgggacaatccccagcccagaagatggtacaatgcatctttacacctcctttcaaggatgggcatctcagatactagacttggattcaagcagaaagccaccctgggatgacatgccacagaactaagagcctcccttttggacccttcattcctgagccacacaggcactggtcagtgcttcgtgggtccagcgcacaccaccctcaactgtgctccgtgttgctaggccccaagggtgggggtgggaagggaaggccaggttgcctgactgaatgaatgaagttggggagggttcgggccaaaggcagtgaaatcctcagatccatccacctttctggccagtgtctgcagtgtgaagtctcaccaggcagagggcagggagcgggagggagggtatagctgcccacgctgcaatcagggcaggcctgacccacagttcaaagtcctgcggaacattccctgtgtacttagaaaagggggcctggatgcagacgctgaagctcactcgggtgcagcgtgcagtacctttgtcttcccttcactttctattcagtatctcctgtgcccaccctacacccagccagtatctcatgactgccagcaatatccagaaactatactaggcattagggagataacagggagcaaaacaggcagaaatccctgtactcacgaagcacacattctagtggaggaagcaggagctttacagttcagtccaggcctcactgaacttgcttcctgacctgctctccccgccctcctgtgtctcgggtactgggagtgcccaccaggaacatggaacagcccacgttagctgaaacatcagaatcgggagggccctgaattccactggtcagttgtgccaccagctcattctccaccagttcctttgctcacgcgcttcccagggaggcacttcctcgcgtacctgctctttatactggtccgcgtgtcgacgctcatcctcaacctgcatgaagatttctttcagcttcttctcagtgcgacggactaatttgttggcggctgctcgttccctgtgaaagtggtcacagtagttttgaaattcttgaaatggtattttgtgtgggaaaaaatattttttaaagccccttttctttgggaagatgacacatggtggaggcattatggacctctctgtccagaattcatgactaatgtgctgaaacctttccttctggtcaaaatcagaattgcctttaatgtattcctcaatagtgacaggtagaataagtgcattattcctgcacgtgtaggtgttaattactgtacacaggtattcatcattgtactcagttatcttactttgtttgtttttgagatgcagtcttgctctgtcgcccaggctggggtgcagtggcgccatctctgctcgctgcaacctccgcctcctgggttcaagcaattctcctgcctcagcctcctgagtagctgggattacaaggcatgcaccaccacgctgggctaatttgtgtatttttagcagagacggggttttactacgttggccaggctggtctcgaactcctcacctcaggtgatctgcccgccctggcctcccaaagtgctgggattacagccgtgagccagcgcacccggcctgtacacagtgatctaaagagcaaatgttacatacaatctacctgtcagttatactgaacatagacttttgaagacaccatccttagtttaatcacctaaacttttagcctgagaaacaacccaatttattaagtgattgtttcacttgataatttactaattacctattgtgatgtagagggctttggcagctcacattgaaaaaaaacccaaaaacaaaccccctacactccctctttggttagaggtgaaacaaatccatgtttccagatgcatctacgtcgtcccatatgaaggagaggtaacttatttggaggactccatggaagacagaaaaagttattttgttgcttaacaaatattatgcaaaagtagatagagacagtcagctgaaagggtgtttatgttaattccaactagaaacaaacccttaattgtttgcttcagcccactggagtccaaagaatggagtgggaagtcctggcacgagaggctggggaggatgcagggttctggccgcgagccctgcatttctgggctccaagctccccagcaagagggtgaatctgaaggtctgccctggctctgggcgctatgacctaatagctttgtaatatgcctgccagcagctgtactgtacaatttctcatcaatttcagaatgctttaatacaacaatatgaaagctgttaagcaatcccttctatggggagaagaaaggctctgatttgtgtcatactgcatttgttctctggcagcaaattagcatttcatgggctgccacacgcttgggaaatcgactttgggtaggagatgcaaactcagggtgcctaggaaatcacggggcgccgtcctaaagcccagccttccctgactgttcacggatgccgtctgtcctcccaggctctgaatgctcacagctcttctctcacagctcacaccaacttctgtgtcccactctggttatatgtgttctctgcccacgtggtggggagcccccccgaaaggggcatgcctgttttgtctctgactgagcctagttggtaagttttggtttacggtagcaaaaacctcttacttggcttcctgctcaagctgctcctccagctgcccaatcttggcctccagggctgagatggtggccttgaacttagacttgacagcaccctcgagttcctgcagcttggccttcagctccttgttctgccgctccagttgctggcgtgcattgtcactcttctgggcggcgctgcgctcggctgctagctcggcgttcagtgtgtccacctagagaggagagaggagtttagtcacttgtgcctgaggggtggcacagccctccctgggtgacgggctcctgcatgggccacctgtagagtggtcttgcggaagcggtcgttgagcagctccatgttgctctgctcctcttccagctcctcctccagctgtgcgatccgagcttccagacgccgcttctcatccagcagcgcggacctggcggggagaggaggaggggacggttcaatcccagctcagcacagcacaggagcctcagggaaggctcctccacccaccctgttgctggaaacctgagcagccatcctgaattttctctttcccctgcactcatccccaaatccatcagtaggtcccactgatgacacttccaaacaccctcccccgctgccaccacccagatgcaggcctgtcatctctcacctggactgctgggtggcctcccgctgccctgcctgcctctctccagctgttctccacagacaacagccagagtcgctttcaaaacgcaagcacgaccccagcctccccaccgctgaaactcttcagtggtttccaatgcactgagaatcaaattctaactactcatgatggcatgctcaaaaaggcgcatgatggacgttcagttcagtaatgacttttaacgaaaaaatgaattcagagaaaggtcctatctgaggaacctgcttgccaaagctagctggaaagtgaaggcctgcagtgcccgttggcgcaccccacggctcccccctgcggtgtgcagggctcagcaggactggcacgggtgcagtgcccgttagtgcacaccacggctcccacctgcggtgtgcagggctcggcaggactggcacggggtaccatggctgaggcagcccaggcccagcgagggaggagcaaaccacccgctgatgccaggtgtgtggacacctccagccttctcagcagtgcgcgtgcctgagggcgaagaacccacccccggccgtgggagactcacttgccagaggcgctgttggtgatctcgtccgccagctcatctctctcctgctcggcgtgtcggcgggctcgctcagatgaggcaagttcctaagcagtggagactgcgttaagctctggctgtgaatagtttcctcacctgtggaatctgacagtgcctggagctacagcgaccttgctcctgtcactgtttacctgcacctcaagctgtcatttagatttgagaaattaaactgtcaagaaaatctgctcggtgcaggccagccaggtggtgtgtggtgtcagcatctgacacagatgtccagaggaaagtcttcattgccataagggctttgctgtcacctccaacgtaagaggtggctatgttcctgcccttcttggaaagctggtgcttcttaatataaactgagcatgaactttatataaaccctgaaccctaagaaacatgagctataccaactgatggccctgaagtatctttcacataaacagtttgagatcaaggacgctggctgcacagaccagtgcggatccaggcagctgtgccgcaacaaggatcaatgctcccatggagaggaggcaggtgggggcctccgcaggggctcaagtgtttgcagagctgggcctctaaggtgggcaaggcctctttcttgaaggggactgtggctccacagggggctctcagaggactggacaatggggacagccctgtgcctgccagcccacgggaggaactgcctgatggctgcttttccacaaacttctttggaaggatgatttgccatggaaaggagtcaagggtgcatttatcttataaatgaggaaactgaggcccacctggatgaagatactggcccaaagtcccaaggttagtcagcagcaaaaagtcagggttcctactccctgtccagggctcttcccaccagctgccccttccaaaagatgccacatttggcaagagcacaccttgaaggtgtcttaggagcagggctgcacgggagctcctctgtctgctccagcacgtgcacctgccttacatgagtgtaggctgaaggtcctctgacaggcctgggttctagcacatcctggcacacagggcagggtgggagtcaggaaggaaagagaggcagctgacggaatgttccaggcctgatcccagggccactgactccagacagctctaccatctggcctctggtgttttgtcttcttgggcctatgaaacactcactgtccactggcttgggggtggggctctaggcagactgagggacccacgggagaaaggaagggaccccggggcctctaagccagatgaacggaggtgtttgagggaaggaaaagtgtcagaaatagggggaagggcagggccagctttccagctcagtctcttctccctaatgcagtgtgagtcaggccttgcctgagagtctgaaagaaacactttcagaaaaaacagtgtggtacagagaatgcctcttggacacttgggtaatggcccaggagcgctctctaggaggcaggctccaacagccacatcgcctttggggaaatgagcatttggggatctcaccaatcaactccatgatggatacatagagcttacacatctacttcattgatgaacatgcatcatttttaagtacccacggaacacttataaaaactaacgtgttctaggtcccagagctctttctcagcattctctgaccacaatgtgataaaactagaaatcaacttaaaaaacaagcaaatgccatacatttggaaatttaaaccgcaagcttaaattattcacaggatgaagaagaaaccataatagaaattagaaaaatttagaattacatgacaatgaaattactccacatcaaaatttgtggaacatgatgaaaaccgatcttagaggggaatttacagtcttttataaacatatcagacaagaagcttgagagctgatgagctaagtgtccaactcaagaagtcagaaaaaaaaggagcaaaaaatggtgagatagaggacagcaggacgaaaacctcttgaagctggctctcaggttctctctcagggtcggctccgtgtttactgatctggttttgagttccttgttcattcctgacacctagagagccgtcctcctttcttgcaagctcaactctgcctttgctaatattttatccaatatttataggtgtttgtattgggagttttttcatattaactgataataacatttaacttaccttttcaggtttgaagaaatgttgattatccatcatttatacggtaatgtgtatatttaagtgtgccttgcactgttacagttcctatatgcaacactttatcagtctctgcttcatgagaacttacaagaaagataaatgaaggaataacaggaattcaatgaaacaaacttctctccttttaagttatcacatgagtagtgcttctgtgtaaaaacaaggcaattttgcatcaccaaggttggagttacacagttcttgtgcttatcaacacttccctttcctgcacaggggaacaggccaagaaggtggcctgaaaagctactcatcagctcctttgccttttgccaggtagaggaatatatgtgagcagtgtcgaagtgataactttctgtttccaaactgaagcaacaagaaggttgaggaccatattaaaaatggatacttaaaaaaataaaaaacaaaaatgtatactgacattacagtgggctacaaatatattaacttttttttgatcttggagaaatttcaagggcaaatatatttgttgaacaaatggataagtaacaaaccaacctcctgcaattgaaggatttctgcttccagactcttcaatttcttttcactctctttggattgagcaaaaatctcatctctggatgcacgagcttcttctaattcacgttggtaatccttcatctgagcctaagattaaataagaaggttttggggtggtttacattcttagttttagttaaaataaaatttttttagagatgagccctggctgtgttgcccaggctgatctcaaactcaaggcctcaagcattgctcctgattacaagtgtgagctgcggtgcctggccccattcttagcttgtaaacatggtattttttttctagattataaaagtaatatacattcattgtaaatataaaagtatatgggaatgacaaggatatcgtaagaaaactacagatcaaaatgaaatcccttatgaatacaaatgcaaaaatcttcaacagaatagtagcaaactgaatctggcaacatgtaaaaaggattatacaccatgaccaagcaggatctatctgaggaatgcaaggttggtttgacaaccaaaaatgaattaatgtaaccatatgatcatcacaataaatgctgaagaagcacttgacaaaatctaataccctttcaatataaaaatgctcaacaagctatgaacagaaggaaatttcttcaactctgattaagggcatcaatgaaaaactgacagccaatatcatacttaaggatcaatgaccaaatgctttccctctaaaagatgagcaacaagacaaggatgtctgatcttgccacttctacttaacaatgcaatagagattctagccagggtaattaattaggcaagataaagaaataaaagatatccagattggaaaggaagaagtaaaactagttcaatttgcagatgatctgatattgtatatagaaaatcttaaggaagacactgaaagaattagaactgctggtaatatggacagtaaaagaaaagaaagcccacaagaactaattgatgagtttagcaagattgcgggatacaagatcaacatacaaacatcaattatatttctatacaccaactatgaacattcaaaataaagcaattacatttataataccatcaaaagaatataaacttaggtataaagaaaaaaagtgaaagacttgtataccaagaactacaaaacgtcactgaaaaaaataaaaaagatctaaataaatggaaagattatccatgtttgtagaccagaagacttaatattgttaaaatagcaatactctccaaattgatttacacatcaacacaataaactatcaaaacccaagctggctttttttttttttttttttggtggcagaaattaagctaaggcaggtgtggaaatcatttactcaaagaatttatatccagaatacagaattgtttcaactcaataattaaaagagagctcagctgtttaacctcattagtcattagagaaataaaaataaaagccacaatgaaatgtcacttcacacccactaagatggttacaatcaaaagatggacaataacaaatgttgacaagatgtggagaaattggaaccctcatacatagctggtaggaacgtaaaactgcagtgactgtgggaaacagtttggcagttcctcaaagttaaacacagaggtaccatataacccagctcaattccactcctaggtatatttctgagaaaactgaaagcacatgtccacacaaatgcatatgaatgttcatagaggcattattcagaagtcaaaaaaatggaagcaacccaaatgtccaactgggggatagacgagtaaaatgtggtagatgtatccacacagtagagtgttactcagtaataaaaaggagtgcggtacttgttcatgtggctacatggatgaactttgaaaacatcatgctaagtggaaaaccagtcacaaaaggccacatattgtatgattccactgatatgaaatatggaacaaaggcaaatttatagagactgaaagattagtagttgattaacgcaggatgcagcagggatacagggaatggggagtgacagctaatgggtggaggattcttttgggagggaccaaaatgccccaaatatgatagtggtgatggctgaataagcctatgaataactaaaaaacactgaaaacactaaactggcgaattgtgtggtatgtgaactatatttcaataaagctgttaaataaaatcacagtattatagtttatattctttgtaattaattagcttaataacttttataattagctaataaaaatcttgagcccaggctgcagtgagccatgactgcaccaccatacttcaccctgggtagcagactgagactctatctctgggaaaaaaaacaaaaaaaaaatctttatatttagcttcaaaaaaaaaaaaaaaaaaaaaaaaaaaaaaaaaaaaatggaaacaagttcctaccaacctattacccagagatgactttccctccaaacttttttctaggtatagtatgtctgcctacatgtctgtatgtgaaaatgtatacacacacatgtgtagagttacaagtcaaaccgtcctacaccatattttcctttattcatttaagtctggccatcattccccacacaccccatcacttagatggttagcagtccattgacatttagggggtttccatttttgctatcataaataacaaaacttctgctaaagatctttgtacataaaaatttcttctttatattttgttaaattttcaagatgtatcaacaaggtcaaaggaaaagttttcatcattaacggaccagttcccctgagaagttgctcccatccatcctataggtgagggccccctgcctgcctgctcacaccatgaactcttgcagagatcacttcttgtcattgtggtaatgaaaactggcacatcatctgggtagaaaaagtgacgattaaaacagaccaaaaagatcacaaaagctacagcactaaggggctgggtcaacatgaccctcctctcgaggtgaggaagggtgggttttaagcatcgccacaggctctcagggccacaggaggccagcatgatgcctccaccccaactgtgttgctaagtgcattcaagtatctcctgtggacacagcggacacacaagcactctctttatggcctgctgccccacccccggccacgctgacagcggtgctgtgccccccagcttcactgctggactctgtgtaaaagccacataggtcacgtggtgccatccagagactccatgggtgaaggcacatacctggagcttgcggagctgcttaatcacctcatcccgagctttgttcgcagcctcgatttgggcttcgaggtccttcaggtctatctccatctttttctttgaagctacagcaagcgcccgctgtttcctctcatcctccagctccgcctcgagctcccgcacctaatggacaacatcgggttatgctgggttacatccaagtatctgctcgcagaacaggcagactgttctcaagtggggggctctggttactcgggtgagtggaaacttctgttactctgtagaggtctctgttaccaaacagttactatcaacagaaaaccacagtagctgaattttgttcaaaggggtctttaaacaccaccacctagtacaaaccatcccactgactgctacgagggcatgcgagaaggcagccagtgacctgagctcggtgtagatgaagccaagatggaaaaacccaagacaatacggtaaccatgtaataaaggctggggtaggcacagagcgggcatggggtggttgctaagaggtacagaggactaagcaggcattcctgtttcctagagctgtgaggacatggggcatggccatgttgcaggggtgtcagaaccaggcagaaactgcctttgatcagcaggaaaggggggagcagtcaaagctgtccaatggaggagggacaaaatgaaggcctgctctggagcaggcagatgggagagtgaggatgagtaagatgtgggctggaaaccgaggtggacacacctgtcagccactcactcactctgtggcactcttcactcagcctcctagtgtgcagtggggatagggaactgtgctcacactgtgtgagggatgctcagaagaaggtgctctggagtccttaaaccaaatcctaacgcctctgtcaccaatgatgaggaccagacacagagctgttgagctccaaaccttatcagcccatgagtccacagggactgtgtgtcattgccttgacatggtcttcccaacctgtcctgcttcttccacttattcagccataaatgaatgtttcgtcatgtatttattaaggtataggtcataaataccttaataaatacctgcaccctatgtagtgcagtagcagctggaggctcagcgagcaaagaaaggtccctgccttcacaaccttccgcttcctgcaaagaggatgatggctggtgtgggagctggtatggaggcaccaaggcttgacggagtggtggctccactggtcctctccaaaggggagaaacaaggccaccgctgctgctgctctgcaggggttggcatgggagaggaggagcagggcagctgcttccgcatagggcagaggtgctcgtcatctgcttgctgtgttctgcagagacctggggctgtacctcaaggcacaggatagcagaaggctcctaatgtagagccacttacatgaatttcaaagtgtggtttaaaaaaatttctacaaattctttaatactccccaccttaaagagttggagcataatctcctcttgaatgtgggccagacttagtgacttgcttctaataaacagaataaacaagtgatcacatgagacttgggagatgaggtcataaaaggcccggaagcttcctccttgcttgctttcttttggatctctcactctcctgaagctccctccaggacagtcaggaggcccatgtggtgagctgctgaggcctcctgctgacaccatgtgtgtgagtcagtttggcacgctcctccagccctggtcaggccttcgaattatgcagccagggccgaggtccttactgtaccagaaccactgactcaactgcttcccaattcctcacccacagaaactgtgacaaaaatgttgtcacagtttgcaataatttgttaagtttggggtaatttcttatccagcaataaatgatcaataattagtggagtgaaaataacaaaataaagcaaaattcagtaattccaaatctggccgggcatggtggctcatgcctgtaatcccagcactttgggaggccaaggcgggcagatcacctgagtccaggagtttgagaccagcctggccaacacgatcaaatcccgtctctactaaaaatacaaaaattagctgggcatggtggtgtgtgtctgtggtcccagctacttgggaggctgagacaggagaatcacttcaatctgggaggcagaggttgcagtgagccaagatcgtgccactgcactccagcctgggtgacagagcgagactccgtctgaaaaaacacacacacacacacacacacacacacacacacacaccccaaatccaaaacttactgccatgaactggaagggactggcaaaatacccacaattcatttttaaagtaaagttttagactagaaatttaacatatatgcagaaaagtgtctaatatacattcagaaaagtatacaacttatacatggatagcaactttataaaaggacaaatttaaatatctgctctttttccttttgaagagtgatctaattattaggacttggaatctgaaccacagacatctgccgaatcaccgtgtctgggatgcatcaattctttcctatacccatgttctaagacaaggaacttgaacctaaccacggattcctttgggagtccactgagggctttctgactgataagtgtctggcttgtaggcaggaatgatactgagaaatagtaagacctaaactaattacaataaaatttaaataataaaattctcaaatgaccaaataaattcattttactctatgtgttactctgtgtttactcagatgtgttctaacacgaatgaacaggatactgacccagagctgggctttgagagcctgcaccccttgttgtggaggccgcaccctctgccctacctgtttgatcagcagccgcttcttctcttcattctgctcatccctggtttgcaggtctctctcgaactgcgccttcatggcctgcatgttgacctccagacgaagcttggcatcttccgtggcctggagttcgtcttccagctcctccagctgggtcctcatttcctccacctgctgctctagggcccgtttggatttttcaagttcgtgaacctaaaccaccgaagcatcaggaaagagttgaccggggtggaggcacatatgaagaacagcagtcttactgttttacaggcccactcgtggcatgctggccactttggtccccctgggccggccccctgccacatgcatacacatccttccctctcccctgaaagctgctgctattctccatttcagtgtatgcagttcagaactacagtgcggatgtctttattcccacgtgttctctggtcatcctcctctgatgacctttaagctgagagctcttcagtgagccaaagaacaaaggaaacagccatgtcagggaacctgtctgttgactgactccttgcctgctgtctgtgaggaacaagtacaacagtacatctcttcttgctgtagagaagatcattcgtattgaaaagcacatgtggaaactgctgattattagggtggcttgggcctaagaagcagggcacagtacacaggccttgatctttctctggacaaagatgcccccagcaccatttccctcattctctgcgccaagcactgtgctgagagctccacctcctgtgccctttgaccctcacagcagcctttggagggaggccttggtgctgctgtgcaccccctctggggtccaggaccactgcagttctcacggggacaggcgcggggaatcctaggacaggaggaaggtccatttctacagtgtctggtgctcagtaggcacaaaagacctgtttgtgggatcaacatgtgagtgttgatgctacagaaaacgaacatgaaatcaactgtagagttctctctccacatttcactgtgtaaccatggccacttctactttcagtggcctctttttgtccatggggctagtccctgggcgccaagttgtaggagacccagcagaaaggtgggaccaccttcgctgacttatgatgtggccagatggcccatagcacatgaaaatgagatcctgcctttttagaggactttgtgtgcttttcaaagcagatgcagtaacttcatgaaattgggcaagtataatgtccatctggcagataaggaaacttaggcttcaaaagcttaagtggcttcccatggtcagaatggaagcctgtggaggagccagggaaccttgcctttgataccaggcctgggtttgttttgctatcttcaacacgtcatacactaagggagagacgtagggtaaataaatatcatggcagctcttgtggaagatgtatgcaatggaaagaaaaactgtgccacagaagcttccaagctgtggataagcccccaaagctactgaagctctcaaagaaaacagtggggcctccctgggaagaaccaggtcagagggagctgccattccctcctcctcctctccaggtccccactcacctcatgtttgataactacctgtgacggcagaaccatgaaaccttttgttgaaaggccctcctgccaggatgcaggctggagcagggagggcagtgaaaggacaagaagaaacatgttcacctccagccagtgctgggggaagactgcagaaaacctcacagcagtcccagaagacctgaaccccgtacgcatgcacaggccaaaacactcctagatggctttgctgctgggctgtgcattcccaggtccttcaggctcccctgaggagtcgcccgctcctgtgtgaaggcccaggcccctgggatactctcccgtgcggaagtgtggagcccaccaggcgacttacgttttttcccacatcatctttggagctcatgaggtcttccatgtctgctcggagctgcttgttctgcctctcaaactcctccttggcctccagggcttcctcgagggcccgggccagtgacagggctttggtttctttctctctggcctcggcttcggcccggtcccgctcttcggcatagcgagcagagatgctcttctcttctgctaacagctgtgcagaaggggatgggggaatacgaaaaaccgaaacagtgacatcaacttttctcttccaccatgtggctgatttatcgctagagtgctgccactagattatggtgttcttgtatttcctttttttttttttttttgctttccctttttccaattttgatataaacatgtatcacatttaaatgcctttaaataagattattttaaaccaaacgaacaaaagcaagagctctgccaggaggaaacgacacgtggccgacccacctggtcaaacttcttctgcttcttctccaagttggaggcgacctggcgctggtggtccaggtccaccgtgaggtcgtccagctcctgctgcaggcggttcttggtcttctccagtttgtcatacgccagtgccttctcctccaggcgctggctcagggcctccgcgtccttcagaagcttcttcttggcttcttccagactttcaattgttcccaggtcgtcatctactttcttcttggtatcagccaactaggttttgtgtacggacaaacagaaagctcagtattaatgtactcaattggggccaggcatggtggctcacgcctgtaatcccagcactttgggaggccgaggcggcaggatcacttgaggtcaggagtttgagaccagccaggccaacatagtgaaacctcatctctactaaaaatacaaaaatcgcctgtctgtagtctcggctactggggaggctcaggtgggaggatcacttgagcccaggaggtggaggctgcagtgagctgagatcacgccactgcactccagcctgggcgacaaagtgagactctatctcaaggaaaaaaaaaaaagaactcaattggtttttgcctttgaagaaaaaaaaaaccttttgtttttaatattttgagagaagaaaaatcaatactgtgattttaaaacaaatgagtcttagactgtcacttaatttcttagctaatagtccataaaatgatgactggattgaaatcttacatcgttgacacagtcctaggtccttattttaagggcttccagcattataaccagcatgtggctgggtcaagaaaaaccatttaatgggcttaatttagtacgacctaattaactgtcccaaatggagctgagacagcccagcacagcagggccaggatctgctgaaggcacacatcgaggccaccgcggcctcctaaagaggacgcacacctgggactgcagggccagcacttgcttctccaggttcttcctggcctcctcctcctcctcctgctgctcctgaagactgttcttctcctcttccagctgccggatccgactgctcaggtttagtttctggcgtgtctcctcctgaagaagctcctgtgttttttttttaaagggcaacacttccattacatttatcaccaaaacaaatacacctgtattaaagaattcatgtcgtacaaaagagacagcctcaatgcatgagaacgcccagtgacattaacaaacacagatgatttaaaaacacacacgataactttgtaaaagctcttcacaccaacactgcttcagactcatctctgaaaaacgaatggcggcgccatccacccaggggcccaggctggagcctccaggcatccccgaggcctcccctcctgcgtcccccaccacaccccgcctctcctcagtcacgcctggaatcccttcctctccaccccctgccccgtcttagttcaggccctcagcccttcgaactaggatcacctctcccgtcttaggcatccctcagttatcgtcctttgtatttcctgccagattgacttctaaaatgtaagcacaaacatgtttttcctgttactttcagactgcaaagtcttcagaggcattggttgtgtggagcagaatttctgggccatggcttcggcctcctctagtctcactcaccaggccgcaccttgtcatgcatggggtgtgctttggtaaaaatgaacttgtccccaactgcctaattattccacttttggcctgtctgagatttttttttttaatccccagcacctagcctaaagcctggcaaataaacactcataagtgtttgtaaatttaacaaaactaagctgtaaaactccaagaataaagtgctacattattttcaagtaacctgtagctgacttaaaaacatccctaacggatgatgcaatacaggtcttaacagtctgataagcctcaactcacccttttacaaaatggactgtttctcacaggtcagcacgatgaaattccaaccataaggaaacaatcttattggaaatggccagcaagacattgtgtgcagcaggaccatagcttgggtcaaccacagcccaggcagcggccgtgaatggcagctggagctgtctccgaggccacccacgtgcctgccagacacacgaaccccaggggctctacatcaagacactgagcttccagggagaaatcccgagtagcaaggctggctccaaataaaagtatgacataaaactagtaagaggtgacacagaaggcaattctggggccagcatatttcaccagcttatatattacagaaatgttagttattataaagaccccttgctccccagggaatacctgtgtatcctgtagttgagactcaagactagctgcatccttagcaaatttaatacccttcttctctgcttcttccagaagggtggagacattatctagctcattctgtaaggagcagaagattaaattcaactcaatagtaagcaagcagaaagggtctagaaacacagcttttaaacagaacacagagaagaactcggcgggagtgtgaacctgaaactacccattcagttaaggaagactcaccaccaagagtctgttgccttcaaacggagctcaaataagtaggtactagaacctgcctccctggccaccttaatagtctctacccatgaaaaggacagggggcggggggtctcctaactggtttcctaccttcttctatttttatcatgaagatacaaaaattaaagcaaagcctctgaaagagtgactgtatcctctgtggggaggctgaaggccagcaggtgcttgattttggtccttcacacgaatatgcgttaaccatatgttttgggaggaaagtataattcacattcttatagaacttgaagcttctataaaaggggtacaagaaagttttttttttttttgagatagtctcaccctgtcgccctggctggagtgcagtggtgcaatctgggctcactgcaacctttgcctcctgggttcaagcgattctcctgcctcagcctcccgagtggctgggattacaggcgcttgctaccgcgcccgtctaattttttgtatctttagtagagacggggtttcaccatgttggccaggctggtctcgaactcctgacctcctgatctgcctgccccggcctcccaaagtgctgggatgacagatgtgagccaccacacccggctggaagttcttttaggtttcaaaaaactggtattatatgttcatcatgaatatttaagctatttcttatggtcagatttaattaataatatttttttcttcgcaattaatgatatttctaaaatattttccaaacaaatctttgtggtataagatgctttataatttttgacgacagtgggtgctgggaagacgcagagggacgcagaggggcagcagggcgccgtgcgttctcgctagtcctcgtcacaccggccaagggagagtggacggtggcacagccacagcagagcacatgctgtaacgcttccatggtcactctgtttagcaacatccttcacagagctcacacttcatcagtcttgggaacagtgtggtggggaagggctccaaagtcaagagggactcctgccttcagcaccagctctagaagttgccaggtaagtcaccagagcgggcaagagccttagcttctttgagcctcaggttcctcacctaccagaggggttgactgaggtttaaatggggaacaacgtacatgggagcctagcacatgcctggtgcagcacaggggacaaggaactgtcactcccctcccttccccgccgtaggcagagttcataatgctgtttcagagattttctcttttaggaatagctttccagattgtgtgtgagagcacgcacacaatatttcagtacctacacgttaacacagcaggccgggaccaccctccttcgaaaggcctgcttgcgatgttgacctttggctggtgtgtgggaacttgaatttagcaagagttcccactatttcctgaacaataagggtggcttttctctaaactgtccatgtaaacaatatggtctatgttgaacacctacgtttcttctgggagtctgcaatttgggtttatgctaggcaagaggtgcctatgtaaccagcccctaataaaaaccctgggggccgagtctgtaatgggcttcttggaagaaaacatttcacgcatgctgtcaggactcactgctggaggaattaagcacgtgctgtgtgactccgctgggagaggactcctggaagcttgttcctggtttcctcagcacctcagccctcgtgccctttccttttactgattttgctttgtatcttttcactgtaataaatctttgccatgagcaggcctctgtgctgagtcctagagtcctggagaatcatgtactgtagtgtggtcttgggcctcggacacaagacagctctgtaattctttttcaatgtggcaatataggatgtacatcttttcttaccaataaggactcatcgactatattgtttttgctggttgcatagaagtccgtattaaacattaaagttatttccaaccacagtcagcccttcctatccataggttccatctgtggattcaaccaaccatgtattaaaaatattcagaaaagggccgggcgcggtggctcatgcctgtaatcccagcactttgggaggctgaggcaggcagatcacgaggtcaggagatcgagaccatcctggctaacacagtgaaaccccatctctactagaaatgcaaaaaattagccaggcatggtggcgggtgcctgtagtcccagctacccaggaggctgaggcaggagaattgtgtgaacccgggaggcagagcttgcagtgagccgagattgcgccactgcactccagcctggccgacagagcgagactctgtctcaaaaaaaaaaaaaaaaaaaaaaaaaaaaatcagaaaaaaacccctgcatgtgcactgaccatgtacagttcatgacttttttgggttatttcctaaaaacatgacttttttgagtcgttatttcctaaaacatacagtgtaacaactttttacatagcagttacatcgtcttaggtattataagtaatctagagatgatttatagtatatgggaggatgtgcatatatgcaaatactatgcctttttttttttttttttttgagacagagtcttgttctgtagtccaggctggagtgcagtggcgtgatctcggctcactgcaatctccacctccctggattcaagcgattctcctgcctcagcctcctgagtagctgggattacaggtgtgcaccaccacacctggccaatttttttgtattttttagaagagacagggtttcgccatgttggccaggctggtctcaaactcctgacctcaggtgatccgcccacctcagcctcccatagtgctgggattataggtgtgagctaccacgcccggccccatactataccatttttattagggactccagcatcagaagattttggtatctgcaggaggtcctggatgtaatcccccagtggatactgagggctgactgtatatacttttgtacacacttctgcaatgaacattcttgaagttgactctgtgtgtacatccttagttaattccctaggataaatgactagacatggatttttcgggtctaaggatactcacagttttaaggctcgtgatctaagactgccaaactgtcctttagaagaggttgcactaggctgtgcacagtagctcaggcctgtaatcccagcactttgggaggctgaggggggcggatcacgaggtcaggagattgagaccatcctggctaacgtggtgaaaccccgtctctactaaaaaattcaaaaaattagccggacatggtggcgggtgcctgtagtcccagctactcgggagactgaggcaggagaatagtgtgaacccgggagacagagggtgcagtgagcagagattgcgccactgcactccagcctgggcaacagagcgagactctgtctcaaacaaaaacaaaaacaaaaaaaaaggttgcactaatttataccagcagtgtaaaaaataaaactctcgtaaatctttgccaatgtgaagtataatttttttggcccattgttcctattctcttatttactggactaatggagaagctgaagtgcttaaaactgttaagcaactataaacacaattcagagtggaactgatcaagtccaatcatgctgtgttcttcttaaaataaatattatttaacttcatcaaagtaatagacactagggacacctaagactcgatgtatttactggatagcaattttcaggtgtcgcacagcacattggccatgggtctcttattgcacagagggatacaatggtaaattagggacatgctacagtgggacgtgtgtagagcggaggtttctggcttacctgcagcttacttgctttctccgccagctccaccctgagcctgtcgccttcagagaccttggcatggagctcctggacctgcgcgtcgagcttcttcctcttgtgctcagactcagccttgacctgctgcaggaccttcacctcacacgccagctccttgttatctgtctccaggccctgcttgttcttctctagatttgctttgaactaggagacggaagggaaaacataattcactagttattttctaaaactccatacagaggactgctttttgagtctgcagaattgtgcctaacacacagtgagtctgtagtcaacatctgttgaatgaatgaatgaaaatgtttgctgttctctgagtgtgaggatttctacgtaaggaacacacgcgtacacactgctccgaggagcagatgcagatatttaggggctcactgtgctaagtaattagccttgtccatgccaggtgtgtcctgtctgcagagtcatcactcacactgtcctctgtataaaaaagtgttgttagtgtaaagaattgttttacacttactaacatgagcaggcacccttggtgcaggggtggccacaacaggatgtatctccaatgacatcctgcctcagggacaagattgggtgtagtaaggtggtcacatgggaatctgggccagactgtctggcttcaagctgcctttccacgaaccagctgtgtgaccctggcttaattacctaacaccactggacctcagtttccttgtcttttaaatgggaattataggagactgtgccacagggttgtagcaaagattaaggaaggcaactcgtgtagggtacttagcacagtacttgacacaaacataaatgttccgtaaatgctaatattgtcattgtctaaattaaaaggtggcatgtggctaggcaaagaacagaaagatggagaaactggagcaagaaccaagtcacaaaggcaaggatgattatgggaagtcatggaggccagtctgcacaggagggtggcgtgagtcacagggcacatgaaattaagtttcaggagaacggaaagcctgtgtctgagatacagaagcgggaacaatgaatgaaagccaacactgtgtttggtggctgaggtgagatcacaggcagggaaggacaagaagggagagatgaatgtcaggaacccctgaaggggaacatcggcaggacgtgtgacttactggcagcagacaagttagggaagaatgactttcaaaccattcggggttttgagtgaagccactgggagaagggtttagtgagaagagacactggggaggactgtgtggtttgagatggtggctggatccatgcacttgcatctggcttttcttcctaaggagacagtgtgttttctgaaagccgctcctgtcttggcaactgggtacccagcagcccactcagtgacgtacagaggctggagcctaatcaatacatgactgaacagaacgggcagataggatgggagtggctctgacgacagactttctccaggccacagcacacggcagggcctcccttacccgcttggcctgttccagctgctctgagagctcctccagggctgttgcgtgtctttgtctcatgtcctggatttgagcttcatggttcttagtttcctcctcaagagctttcttcagctctgccacttcttgttcacgttttgtactagagaaggacattttttaagagagatcagaattagctgactgattaaaaacacattttctttttgaaaaagtactgtttttgttttaaatattacataaattcccttaataaatacttgatgtgctatttccagtaggctggcaggtctattactgtgatatcagaaatcctcctagagagctgagtagtggttcatgcctataaccccggcaatttgggaggctaaggtggatcgcttgagcctgggaggttgaggctacaatgagctatgattgcgccactgcacgccagcctgggcgagtgagaccctatctttaaaaaaaaaccaaaaaaacaaacaaccagtgcaacttccatgccatgtctggcttatcaagacacagggtgacatccctaggggtcttcaaattgttctgggtagtctggtttcaccggaggtcaggaattggttaacacaagatgccaaactgcctgccatagccccaacagacttgaataaaactggaaaaagggagtctcccagagattttcaaaagtgaaggggtgacaaaggccaaatgaatcaggacgttgcagtgtaacaaagcaagactcttagcgtccatgtgaagaagccgcaattaactaacatcctcccaaaattctaccaggaaatggcttaaggttggggaggagggcattatcttttggaggggcaggaaaattaaaaggcagctcaaagggttcagaaagggtctctgatgtttgatatgagaacacagcaggtctatggccagagaattggaatgttctgacataaactgtggttttatctaacctgcactttacggtatgaagatcacattagcattaaatatctttccatggctttctaatatttttaaaattggctgtaacaaatacagggtaacttgaataaccagagttattcactgtctaaaagagatcttacttctcatggcgagtccctctaaatttgttaatctgagcaccgtgtttaagcacgagcttgatgaagactgaagccagtcaggtaaacagcactcctgctaagacctatattagcactgttgaattagctacaacctcacactaatcctgaagcacactgctagcaaacttgctctatactttataacatgtcacaacttagaacagtgatttacacactgattcccgtgtggacacatcatccctctcttcacctctcttttcctctcttctcatggagtcacgagatctgcaggggctggctgagagatccctgtgccaagagaacagggcctggtggctgccagctccatggtcgcatgtagcccagccagaaggaatcactaaggattctttgtggtccagcctagctcagccccaagttccactggctcagccagaggtcaaagacgtgctggtctggtcctgtcctctgcaaggctcccatcgagattgtttcagctcactacagggaaatctctcctactagcagcacgttgtcttttgggaaaatagttgtgtgtgtgtgtgtgtgtgtgtgttcctcatccctacttaaatccagtggtcaaaggaaaccttcatcttctcttctccaggctgaacaaccccatttctttcagtttttcatcaaaagtccttaagagagtgaaaatgccagtgagtctgcagaagactcactgttactttatactaatcatgggaagaaccagggcccaggtggggtggtttgtgttctctaagggtccttagcaagaatggaggacatgtctgagctgcaggcaaaacggaatcagtgagtgctacagctgagcacaggcatggttttaataaatatgcgcatttagttttttgcaagggttggatggaaaaatgatcagaaccttattttctattgcagtcaaaagcccagctgggagtggagagttcagccaagtctagttcagtggtttctagattttaaaaaagcagatatgtcaaagagaagcccaggacttaaactactaaaagcagttactctgctgaagtggggtaagggctgggcgcggtggctcacgcctgtaatcccagcactttgggaggccaaggcgggcggatcacctgaggtcgggagtttgcgaccagcctgactaacatggagaaaccccatctctaccaaaaaatacaaaattagccgggcgtggtggcacatgcctgtaatcccagctactcgggaggctgaggcaggaaaatcgtttgaacccgggaggcggaggttgcagtgagccgagatcgcaccatcgtgctccggcctgggcaacaagagcgaaactccgtctcaaaaaaatataaaataaaaaataaaataaaataaaaaagtggggtaggaagcctcgaaccatgcctggctcagatggggtttttcctctctctgggtaaaagctgaagacaaaaaccaaccaacctctgtccggctgccatagctgtacatattcatggctaggatcatggcaaacattccaaggctcacccctctgttctccagcacggagagcctccccacacccaccatctgacctcagtctcactgctctatcgagccggcctgccctgtggacaccatgatgtcattctttccacgaccaagtgcccaggtttccagctgctgggtggacccagctgatgacatccttgtcctctggggaaacgcactggttttcaccacaacctgtttccctcctggttgctctgggtcattttctgcctctctggccacacttgcattcataaacaattccctctctccttcttgctttattccaggcctcagcaactccccagggtgatgggctatcctttccatcattcataccctggaagagccagcaggtgtgcctgcagccagccaaggcacgagggttcccttctggctaggactcctggggtggccctgaggcacttggcagtgtgagtctgggagggagcagatggcctctgccaggacagcaagctggcacaccccccatgctgctctccacagtgatgacacctatgagtccgtgggagccgcaggccagcacctccaggcctgcgtaccggctcactgctaaggctctcctgcgactcgtgggctgccacactgcagctttctacccaggagccttctctggccatgttcacctatgctcgtcacttttttcatgcccgccctggctgctggctcatgatgctgcatatgcctctgcccactgcacactctgtcccagtgcgtgcaccagccttcttctcacccttgtgaaggcacccttcccttttcagctggttacctacaccgttcacaccacctagcactgccagcatgtgtgcctggcctcctgggtatctcctcctattcctgtgtttacccttctccctctggtcctatctatctaaatctcttttcactgccccctgctctgtgtagttgtcactctctccccctagatatccatcactgaccacagcttttccgatcacatccatctccctctgtgtccctcagtctgctggtttacccacccacccctgcacaggtatttctacccataggctggtctgtttctaaccattaccatttaatcaccgttccacctgccatcacaaggaaaagcacaccacctcccaaagatagcaagcacaccaggcatttctgcacgggctcggtggagaggtcggcaggcgcccgggccctgcttcctctcccacactcaccgtagttcctgctgggctgccgtggtgtccagcgtgtcctccagctctgttttcagagcttccagttcctcactcaagtcccttttctgcttttcggccttgttccgtgaagccttctcggattcaaagtcttcctgaagttcagcaatttgggcttgtagctctcgcacaactttaagggcattgttcttatggagtgtttcatcatcacctctgttaaaacacccaggcgcaagaggcactcagagatggcacccggatggcctgtttctcaggcgagccccagcccctgagcacctctccacgagaccccagccccacatccctcctcctggggcctgaggctggtgcagatgctcagcacctgctagggcaggaggaggttctcaggtagaggccttgctgaaggccccaaagctaatggtggcagagccagaactagattccagccccagccccctttccaaacgaccatgcttctccattaaaaggtaggacactcttactttagcccttagaatatgaaaacattttctctgaagtcaaaggctgttatagttaaaaatctgcttctaactatgaaggagtgacctcctcatcacaccggaacccagccaaaccagggatgctcaaagaacacagtagaagaaagaggctctcatcctcataccctccaggtgcctctcttccatagggcatctttttgtttatgtctgtggtttaaaatgttggaagatttttctgattgggaatagttgggatgtttgaggtaagggagatttttcttgaaagattttgattgtaacacattataaactccaagtattacaaccatgtagccaaatagttattctttataaagaaatgaaacattagacatatatttattacatctgatttgcattctaaactgaatggtttagaactgattattgaatcatgctctcagtggagaaatataatttttgaaaagtgatttcccttcaagttctaaaacatactacaggctgggtgaggtggctcacgcctgtaatcccagcactttgggaggccaagtcaggtggatcacttggggtcaggagtttgggaccagcctgaccaacatggtggaaccccatctctactaaaaatacaaaaattagccagtgtggtggtgcacacgtgtaatcccagctagtcgggaggctgaggcacgagaattgcttgaacccaggaagtggagtttgcagtgagctgagattgcaccactgcactccagcctgggtgacagagtgagactccattcaaaaaaaaaaaataaataaaacatactacagttaatctgtaatgtacagagaccaaaacatttgttatagtgaaataatttgttctggtgtgaatttccaagggtttcataatataatttgtcattttaaagtataaatattgagatggtttatgagactttcttgctgtcctgacacaaattctgtacgcctgggcttttcactttctcaggtcacaccaaacagcaagcaaaccccatctcactctcccagggtttttgaatgctcccgaacataacaaagtctgctgaaactcagccccatgggctcccgtgcagcgcagctgctgggctgcagacctggccagtgcgccctgcagctcctcctccttcttggccagctgcagcttgagctcatcaatctgcgcctgcagctctgcgatctggtcctgcaggtcggtcgtctccccgtcgagttttcttttggccttttccagttcctgacgagtcttttcttccttctttaagcgttctttaaggtaagacataagaagctcttcaacacaccgagtgactcaccacaggaataaactaaaatacagactgatccaagttgaaaataagccattttattcaaaagcatgtcactgccctgatgacatggtcatgcgctgatgtcaactgctcagtcatttcaaacccaccgagatctggaggggagataaattagtgtggggagggaattttaaggaagaagttgagtgtcctaagaatgtcctttcatgggaggtgagaccacactgtgagagccgaagggagctggaatcctctcatgtcaaacacatcactgtacccaggtttgcaaagtggctcagcaggtgctggggcagcaatcgtagctgcctgtcaccccattcccttttccatgggaacccctgttctgaaccaagaaaactgccatcctcgagtactgggagagaggagacagaagagtgggcagagagggccaggccttttctccaccctcccctctaaaattctgcagtgatctctcagttagccctagtgatctatttcactgaatgatttatttcctcacaacaacctgtatgcctttgtgttctccaccaggaaccaatttgctgagaggatgagaccgagtgtcacaggctgatcaaacaggtgagtaaaaaagcacatgtgcttatgggtacttcctcagcagaagaaccatatactagtacaaatggtttatgaaagtaatttcatactgacatgccctcttttgtttatactaaaacaaacaaacaaataaaaccccaaatattttttaaaagccaaccccatcgtcttcctatcataaacgcacacattaaccaagagtgggcacctgcctgcaggcgcctgcacagagctccctccccctggtgatggtaccagtctctagctgctctttccaacttccatcctcttttcttattgcttttgcagaagctgtaatgtcctaggatttcctgatattacactgtggcttggccctcagtagtgtcttctctgtatctgccagcttttatgtcactggccagtccctttgtgaggtactttgtgggcactttaatacagctttagattaaacacaatggtctgtaggacccaaacaatataaccccaaccatgcccaccaaagaacagtatcttttaccacagtaccaaagttaaaaaaggaaaaccaggcctggcgccatggctcacgcctgtaatcccagcactctgggaggccaaggtgggtggatcacctaaggtcaggagtttgagaccagcctgaccaacatggtgaaaccccatctctactaaaaatacaaaattagccaggtgtggttggtgcatgcctgtaatccccgctacttgggaggctgaggcaagagaattgcttgaacgcgggagatggaggttgcagtgagccaagattgcgccactgcactccagcctgggcaacaagagtgaaactccatcttaaaaaaaaagaaaaagaaaaaggaaaaccattttatcatcatttcaaggcaacacaaaataatcttaagagccctttttattatgttttaaatacagggtctcgctgtgttacccaggctgtagtgcggttgcatgatcatagctcactacagtgagctcctgggcacaagcaattctgctgcctctgtcaccccacgatcacagctcactctggtgagctcctgggcgcaagcaatccttctgcctcagcttccaagtagctgggactatagatgtgcaccactacgccaggctaatttgtaaattttttgtagagatggagtctcactatgctgcccaggctggtcttaaactcctggcctcatgagatcctcctgcctcagcctcccaaagtgctaggattacaggcctgagacaccgtgcccagccaagggacctattttaataagtcaacccaaactgaaggtccttattattagtaatcatcatgtatattttttatttttgcatgttctgattacagtaaaagctaaacactcacatgtcctagtccctgatttctctagccccaaatactaaccttctaaatctgagatcatcacttcttgcttattcctgattttggccaagtttttcgccttttcttcctcttcagccagctgagaggaacactcagcaatgcgatcttccatgagtttcttttcctggacaggaaaaattgactgcttcagaaaagccattcagaatgaccacttgggttctgtattcctcataaaggtcaactttgactcgagagaaaataagttctatcggcactgcctcccccagcagactgtacacaatcacatgctgcagaacgatgttttggacaatgatgaaccggatacacgacagtggtctcctaagatgatcatggagctgaaaacttcatcgagagctgtcataacaccacagtgcaattactctatttttaaaataaatgtactgcagcctcagtgtgccatgttgataaagtctgcagtcatgtacagcaatgtcctaggccttcacattcactcagcgctcactcactgactcacccagagcagcttccagtcctgcaagctccgttcatggtgagtgcccaatagaggtgtgccattttaaatcttttctatcatttttaccgtaccttttctatcatatttttactggacttttgtgtggatatgtttagatacacaagtacttattagcactgtgttccaactgcctacagtattcaggacagtaacatgctgtacaagtgtgtggcctagatgcaatcagcccagcgtctggtctaggtgtatagcaggctctaccatctagtttgtgtccatacactctatgatgtttgtacgaggataaaataacttcacaatgcatttcccagaatgtgtcctcatcgttaaacaacacacgactgtactccaaaagggcagaaaggcttacacgtcttggtgcccaccccgggagcttggcccagctgcctggtattcagagtcccacagtcaatggtggatgaattaatgcttgcacagatggagacaagtcatcattgagtgaccattatgcacaaactgcacatgttacaagtctaaaagattatcaggatatttgataaggtttaaaaaattcaatggtgcctgtatctttagaaatctatacaagtagagacttacagagaaaattcagtaaatgaacctaaaatcttgagaaatttctgtttgagttcactttcaatgagtgtatcaacataatattatataaatattttctgtaactaaaatcagctttttgtgggaacactctcttactttgatgaacttggaattttggtcctcgagaagcagaatctcctcttccatcttcttgatcttggcctctgctgtcaccttttccagctgcagcttttgccgagccccttcctcctcgtctagctgttcttccaggtccttgtgaagaacacacagtcagtctcgccactttctcgagatttgaccacacattcattgtgcacaggaatgcattacaatgagatactaattttttttttttttttgacacggagtctcgctctgttgcccaggctgaagtgcagtggtgccacctcggctcgctgcaacctccacctcctgggttcacgccattctcctgcctcagcctcccgagtagctgggactacaggtgcccgccaccacgcccggctaattttttgattttttttttggtagagatggggtttcaccatgttagccaggatggtcttgatctcctgacctcatgatccatccgcctcagcctagatactaatttttgattctcaaaatgccaaggatatttaaaaaaatatgaaatgcagttatgtgaaatagacatttgtatccgctacaggctaaagtacaaactgggtcaatccttctagaagccaacatggcaaaacatagctttaaaaatgagcctttcctttcaaccagcaatttcaggaaattgtcacagatgcaatttatataaaaagacatacagtgataagttatttataatattgagtaactatgaacatgctacaaaaaggtcttggtaattaaatgttggcacatttgttaaatggaataatatatagtaattaaaattcacattttggaataatagcaacacagacaaacatgaataatgtagtagcactcatcaaatgtgtatttaatttagctgaatccaactatatacatgttcggccaaagaagagagaaagagaacatgaaaacaataatttaaatagtacaggtcgtgagaaatgagctgtctcagttcaagtgtacctttcacagcagaagcacctcatcaaactgggcgggagcatagagtttacatgtatttttattagaacgtgcagatctttataatctacattactgtttatgataaacatgctattacacaggatcacagatagattaccccattttatatgaggtgattattacacactacatgcctgtatcaaaacatctcatgtaccccatatatatatatatatatatatatatatatatatatatatatatacacacatacatacatacacacacacacacttaatatatacgcataaaaattaaaattaaaaacaaagtgttacagctcttttagaatttgtctagcaggatttctggtttctggtggaaagctcccatcccctccaaaaaacgaaattaaaaaaaaagttaaacaaaacaaaacccaggctgggcgcagtggctcacgcctgtagtcctagcactttgggaggccgaggtgggtggatcacctgaggtcaagagttcgagaccagcctggccaacgtggtgaaacctcgtctctactaaaaatacaaaaattagctgggcgtggtagcaggcgcctgtaatcccagctactggggaggctgaggcaagggaatcacttgaaccgaggaggtggaggttgcagtgagccgagattgcgccattgcactccagcctgggcaacaaagcgagactccgtctcaaaaacagaacaaaaaaacaaaaacaaaaacaaaccccaaaaaaccaaaactagggttgtacaaatcaacacatggccaacttaaggaaatgttcaagagtaacttcggctaaataatttactcatcgttaattttagaatgaaaccatggcaaaaaatgagtgttttcttgtaaaaatttcaaacacacatacaagcacacagaccagcataataagccccacacagaagcatcaccttgaccttaacaagcatcaactcatggtcaattccatttcatgtgtgcctccacctgctcccttctccccctaggttattttgaagcaaatcccagacatcatatttcacttgtaaaaccttcaggctgtacctctaaaatataaagaccatttaaaaagcacatttgtctgtttcaatcacaatccaaaaattgtgcctcatgagtacagcctgtatttcaaaaagaaagttaagtaccagggaagggctaatttttaaaaattctcattctgactgttggccacctcctatgtcagtgctgagcgtttcttattagccaaaccacgtagtagatgtctatctaatgaatggagtgagcaacagaatcactgacaacatgaagaacaagttaggtcttctacagaatgctatagatcctgggaggtttgcgactgtgaatctctttgcaaactgtaagatgccacttagaacataaaaaagattcctatacaaaatgacaaatctttgttcaaagaaaatctattataggtgtgtttcaaatgatggtcatctttctaagagtggcttctcataacccagaacccttttgcttctctgtggacttaagaatccaaacacataacttctgtttattcaacagatccacttgaaaatccaaaatatgcttctaagtaaaaattattatacatacctgaatatgtgcttgcatttttttcttttcattttggaggatttggtttctttcttcttcttcttcaaccctagactccaagtcatgtagaatctcttctaattcctgctttttagcagcaagtcttgccctcatctcttctgcttcagcaaagagctcagtctctgcttgtagttgttctgcaaggatattcttctcttctaaaagctgcaatcacaataaagtgtctgtgatttgcccctattacatacgtacacagtatatattcgccgtgatttcaatggtcaatgcacatcaaagaaactgggagataaaaatatataacatcacgggaagaactttcaaatacgtttttgtctatagcaaaataagcaagatgaaaatattttggttgttcctgttgtctcaagttactgtgaataatacatattaaattcatgatagttcatctatgaaggtaatttacaagggacagataaataggagagtgaaaatattattcaaatgccataaagttcatggtgattactaatgcctgtttggtagtaagtgatatccttggcctttattgttaatatttttggccttgaacactataattctattattgccacaacaaacatctcctgagcctcagctttgtccatgaagaaaacttcccagaagagggacacacattcaagaccactgctgctagagaagttcaggtggtgacctctactcaagcatctcgtcctttgaccatttttctatttcccctcataaacagacataggaaggtgacagtaccgggaacctcatcgaaaacaggtgttaagtacatgcttgacaccaagaataacaaaagcaaagatgcaagaggtaaggttgattttaacttctacaaatctaaaatgcaaggcagaatgtatctgttaactctattggcaaaatatatacaatttggaaatgagtgaaaaggcctcccataaaataagatgatatggtgggtacagctattcataatgaaatgtgtcggggttgctaccagtgcaagatctcatagggattcagggccaagtgtgagttacaaggtcactgcacacacctgctggtgcttccgctccatctcctccagctctccttccaccttcgtctgcttctccttcaccttcaacagctcttcatctttggcctgaagttcttcctcctggcgagtcacttgtagaagcggcttcacctatgacaaaattaagcagtttttttttttttatcattccagctctttcctatgggtttttcctgatcagactctgctatttgaaagggatctggaaagaagtgagccaagctcacctttgtgaagactcgccaccactgccagtgccgtaatttcaggtacgcggcacagttccgctgcaagacctttaaggcacttagttgctgctgcttcttggcaaaggccctgaagaacaataagaaaaacttatgatgtaaagaaaaaagtgcttgaatggctgttgtcataagaagcctttctaaaggcccgtgttcttctttgtctaggatagggaatgattgcatcaatcaagtcctgggtgagacgcacaaggaagccgttctggccgctcgaagccacactggcttgttggcctgctcagcccacctcaggcccctggcaccagttcctgcactgactttcttcagggacgctgccctgcacattctcctgctgccactcagccatatacccacactgcgcacactaagaaaccgattttcctgaggcaatgaagactgtagacagaagggcccgttttctctgtgctgctctctttatcgtgcctttaggagctactctcgttttccttttgatatgtcacagaagaaacatttctccccaacccccaaggtaatttttctcctccttccctccactttgccgcaatggagcgcagcactcaaaagctacaatggggttgtcaatgtctctcatttacggcccggcctcctccagggcctggagatgactctagatctgtggagccctcacctccttgtgaccatacctgggcttcccactacaccctgtcacctcctcagccccacagcagggtctgagacccagttcccattcgccttcactctactatttttcaatttctcactctccttcaggaacacagaaaccctcaacccccctcctgccaaaaacaacccccaggcccaaatgaagctcattaccttgcggttccttcgacagacaactgacatttttctactccttatgaaactctcagggtccacaggcaaacgttcctattactgacttcctggcttccagcagtcggctttctatcccaccacgctaccgaagctgcattttagatcttgacaaaggactcccagactcagaacttagcggcttttcctcagccaaatccaagtgcctggcacgctgcactcctctggggactacccactactggacatctcatccctgcattccagagcaccagaacggcctccgagtctcctgggccccgctaacagtgctgatgctccactccgacagtccactcacacggctgcgctcccacctagactctgagttcctcaggagcagggatcatggcccaggcatttttgttggcacaaccaagtgaccgacagactccaggcctcctgaggatgtttgttgagtaaattaactgggtatttcctagaaataatctgtaattgtttctctggagtccttttataacggcttgcaggagtagctataggactctcctgggaaagagaagcaattgaaggcgatggaaaaaataagaaaaacattttgaattattcattcactccagcaaacagcggtatcaggagtgggagtgtcttaagaaaagacagacagttgctgttttagagcaaaaattacctacctgtcacatttccttgcaagaatcccacaactgctatactgccaacgaattcctccttgctggttagaattttccctgaacccactgcttcataactgattttattcttgctccttacaaaaccttctaacttattcctaccagccaaaaagaattagccaagtctttttttttttttttttttttttttttgagacagagtcttgctctgtcgcccaggctggagtgcagtggtgcaatcttggctcactgaaacctctgcctcttgggctcaagcgattctcatgcctcagcctcccgagaagctgggactacaggtgtgcaccaccatgccttgctaattttttgtatttttagtagagacagggtttcaccatgttggccaggctggtcttgaactcctgacctcaagtgatccccccgcctcggcctccacaagtgctggaattacaggtgtgagccaccgtgcctggccgggattggccaagtcttaattccaagagtttctactacaaaaacaaaagtttcaaaaatgacttttgaatctattaagcatccaccttccaattcttgcaatctccttcaggaatgctgtacaaattcacccaatcttcttattaaaaactactgccctagttgcttctttggccctctgggagataaaactgtcaaatgatgagtcagaaacatgccgggcactttgtttagtggaatgaggcagctggtttccttctccgcagtggtcggctgatttctattacacctgtgtgtcaggcactgtcctccaggttttcatgagggagctgtgacatcaacctatctccgagtgtttggaaagtggacttcaaaagtgttcaaaatcactttagctccttccccctttttatccttatcccaatgtcctccagggtgcttcaagctcaagttcatggatttctgtaaagatacctattattttgactattgtaagcactattctgcctttttccacagtacaatctggttcttttgaataggttatcttctttttttgatgtatcctgattttaagttccagcctaccatatgcatagtgtgaataaaatattgaggggcaggggctgcaaaggcaaaggcatgctggcttacatataagattacatggatttgttagctttaagtccttaagatgaaataatgcaagtgaaatatctttgtttttaactttctatcttgaaaattttgcaagcaaggtttagatcaatgaaaaagctgcacaaagtatatctatatacttcgtttcctgcactttcgatagttgtagcatgtttctggcagatgtcaagttttttgctaactctatgaagttagcctggcacctgccattgctcactccttatgctatgttaggcattctgcagttcagtggatacagtgaggagagtctctgctatcaacaggttctctttattatttatatagtatctaaatattagtatataaaaacccggccgggcacagtggctcacgcctgtaatcccagcactttgggaggctgaggcgggtggatcacaaggtcaggagatcgagaccatcctggctaacacggcgaaaccccatctctactaaaaaaaatacaaaaaattagccgggtgtggtggcgggcgcctgtagtcccagctactcgggaggctgagggaggagaatggcatgaacccaggaggcggagcttgcagtgagccgaggtcgcgccactgcactccagcctcagcgacagagcgagactctgtctcaaaaaaaataaaataaaaacccaattcttttactcctttttgccaaatgtttcttagtatcaacccgaagatatcatctatttgtcttcaactttccatgctactctttttactctgtattctattttataggcaaaaatccacaagtattgcctttaccttcttccgtttaaagccctcttgaccactatctgggcaagcagactgcccaggaaccagagctgttttccaacccacatgtagagtacattattacagagtgctgacttccagtccaggtgttcagattctgtttgctcaaaactgtctggatggcaaactattcaacctgtctcaaattctctcactcccaaacccgaagtgttcagtagaaagaagtaaataccagtattaccttctaaatccaaatcagttctaagtcctttgaattctatctcaaatttaacaacttttctctcgttctccaccaccaccttcttgggtccaggcaccatcatcttctacccaaatcactaagacagcttcccaactggccctcccaattctattcttggccaattctcaatggattctgcctaccgcagccaggcggccttgacagtatagattccccctcactgcactcctaacccctgtccagcgtctgattctcaagcctcttctctcaccttgctccctctcacccatcctgctccagccacactggactgtgtcaccttctcaaatgctgccagactcttgccaggatgctgctgtagttcccttactgaaaagcttctctctcctcccttcacagggccagccttcttacccttgaggtttcagcctcagagaagcattctctgaggacttgagctgaagcaggaccccataccccttggccccgtgtgtgtgtgtgtgtgtgtgtgtgagaagcattctctgaggacttgagctgaggcaggaccccataccccttggccccgtgtgtgtgtgtgtgtgtgtgtgtgtgtgtgtgtgtgtgtgtgtttgagatagggtctcactttgtcacccaggctggcatgcagtggtaccatcttggcttattgcagccttgacctcctgggttcaagagatcctcccgcctcagctcccacaggtagctgggactacaggcgcatgctaccaagcctggctaatttttgtatttttagtagagatggggttttgccatgaagccctggctggtctcgaactcctgagctcaagtgatctgcccacttcagcctcccaaagtgctgggattacaggcctgagccaccacgcccagcctccttgtgtgtttttgtattgcaacatcccattacttagaatgttcatgtatttacctgactatctctgccactataaagcaacttctgtaaggacagactatgtctcacacactcttgcaccccaggtcaaaatgcaatgcttatctagcacaagcacttcctcagtgaacgattaattcgtgaatacccactcactttctggccaggtaacctctgcaaacggcctggaagaagataatgatatcggtgatttttaaatctctttcttcctctaagtgtgccagaactccagctctgaaaaatatcttgctctgtccaattctgtacaagtttgggtccaattctaaagcccggatctaagagagaaagagtttatttactttttttaactacaagaaagattagattaaatctacaagccagaaaaagatcaagaaaaccttaccattcgttcacaggcctgtttaccatccataaaacctttaggaatagcatttggagttaggatctcatatctgtaagagaatattccaagaagtattttgtagaaatttgtgaacgatgtgtatctactaactgtgtgttttgctctaagaggcaataaaatgttgggtaatacatgttaaagatatgatgtaatacatgttcaagaaatgaactggtgataatctgatgttttctgtagatctactttatttctcataagtaaaaatgaggttagttctttcaggtcaaaaagtaggtttaggaggttgtggcagagaaaaatcaaaagcatggtgttttagaaacctttcatttttcttcatgtcccataaaatgttcatatccttaagacgcaaaagagaatctggctttctgtactttaagtcactgtcaatttgtagcatttattagataacaggaagggctgtaagagctgtgttcataggcttctattcaaaacatcagaaaatatcagggtgacatgtgacatgacgttggtctgggtgtatacacatacatatgttcactgagctgcacatttaaaatctgtgtacctcactgtatacagtctatacctcaatcagaaaaataaaagatactggctatatattaaaggaggaatcctggctacatcaatcaactttgtatcttggatgccaattatactccctttttctcctaacaataaaaaatgaaaatctaccagacttcatcatacaatgggatcagaatgatggctttcctcaagacacacatggactggaaaagcttctcaaggtgattctatctggaacagtgggagaaagggcacaaagaccattctttgacctggcagcaccatttatttcatggaacagcaaatggtgtcatactttcaaatctgatttccagaaaaaagaagaaaaaaagcaaactaaaagtaactattcaagaaaattaccaaataaaagttaaaaataactctcaacatatgtttgtatccatttccactgcaagttgatagatcttttcccttttgttttttcttaatccttttctatctactcctttccctatgttagctaaaagactgtaattgcacgcatgtgtgtgcacatgtatacacatacattggaaaaaatacatacacatacacacacacatacagatatattcattgagaaaagatggaaagaagtaccccaacatgtttttaggaatcactccttgatgatttttatttacttttttacttctcttgtattttccaattttcctaaaaggaacatacattactcatctatttaaaaaatcaattttaaaaataattatgttaggcctgtaatcccagcactttgggaggccgaggcgggatcacgaggtcaggagatcgagaccatcctggctagctcagtgaaaccccgtctctactaaaaatacaaaaatttagctgggcatggtggcacgtgcctgtagtcccagcaactcaggaggctgaggcaggagaatcgcttgaacctgggaggcggaggttgcagtgagccgagatggctccactgtactccagcctgggtgacagagcgaagactccatctcaaaaataataaataaataaaaataaaaataattatgtttgaatcccaggtagaactgtctgaatgagtaaactgtaagctttcagctttctatgtttatctcaaagctaacttcagggccctgaaaacatggcatgtttctttgcagcgcccatagcagttcctagcacactccctttttataaagtaggcactcaatcttcctaccaataatcaaggtagtaaggattgtcccttttccagaacctcactatatgtttgctatataagaaaacaaactatgtaggggacaaggaaaaagatttccttattttatcactgttttaattcatatcaagataaactctgatacataagcaaaaaaagtaaaagttagcaatacctctgtctgaattcctggaaaactattcggttagggaagccctggcgacagattcggatcccttccaggacaccgttacagcgaagctgatctaggactaggtgtggatccaattttccagcctaatcaagcaaacaatagtttcatggtttaatctttagcatctgacctagatcagttttaaatactagcatatgttttgctcagcacgtaccctcttctcgtgatttggaatgatacaacgaacaaagttagggttggtgtttcggagagttgccatcagcttggtgagagattctttgtagagttgcccaacggtacgaaacatgcccttcttggttttatatgcggagccaaaagctgtctcagtcataccagtgacttgatccagacccacgatacggtccactggggagaagaaaggagaaaacaaatataagccaaacctcactcgttagcagggaaagaaaagacacagtgaaagtgcagcagcacaagctttgtggaacaaatgacaggagatgccatataggtaaggcagtcagcatacttaggcactgcacaagccgggaactaacagccacacacttatatggcaggatactgtagtgctttgacagctccacaccaacacacaccagcagatgccttccgctgcgctagtttcaggaattcactgtcttggataacattctgactgttacatttacaattatttggaaaatgaaaactcattggctggcattattgatacatacaaactgatactgtgaaaggcctccaaataggaaatggctcataaaaatatatataagaatatctgattgtacaaatccacttaacaaataacctcagggactagggaccagaattctctcttattagtcattagatattcagtgagaaaagtcattcaagttttaggaacaaatgcaggaagattagattacaggagttcagatttttagcaatgtgtaagcttcagttctcttctcaaaacatgaataacacttactaaagggcaagaacacaaaataggaaggactcttctgaaaagataaatgactaagcttcctaggtgttcaatggctaaacttgtcagacattcccttgttacagcaaccgatagttttacattatccacaaagacctagtacttctaatgatgagaccataaacagtacaccagccacaagcaaaacatttggtgcataatgtacatatcctcttattgaaaagaagttaaatgaatgaaacacattactcaaatactttaaaatcaatcagaattatcaactgaactgccctttttaatgccctcctcaaccctaatggacacctcatttctttcatttgtttcctttgacagaagcatatggggacctgacactgtatgaagagctttatgtgcaagatctcattcaattatcaatttccaatgaggtttttaacacaagagaaccaagaccccgggaggtaaaagtgaactgctcaagttatgcaggtcttcagtggaagctgggagaagggcgggtaaaagctgtttaatttccaggcccatgcaggcacactacactacaactgcttccaagcaaagctaccagattcaagggtgtgggtcagagctacctcttttgcttgtgcattggagactgtctacctcagagaccaccattctttcctgtgccttcaacctctccctcttcacttgccccagcagaaagcggcacaaacccacttctgcaggccccataaaatactgatcttcccttgaccctgtatctgcccacttctcttgtcagagccacgcttctttcttgagtagttcacaccgttgctacaccatatcctctcccactaacttcccagtgtgtagccaactggcttatggcccgtcctcttcctctcctgcccaacactactcaggcaatgactggtcaattgctaaatgaatagacaccacccagtgcttgtttttcttgaccctggtacgtttacctggtgatgtcacagcaccattgtaaaaactctccactcctggcttttttaggagctccaccttctcctgtaccctacttccccctcactacttcagtcccatgtttcttgatgatttctcttctgcttttcctgtacctcatggcactcgcctgggatcccaaatcaattcatctgcaacccttctagaataaggcacaatacaaatgctgacactggccctctgcttttctcaagccatattcccaacccaggtgatctcagctatgactctaactagatatacctgaccacccagagccagctgccaaacacctgtgttctactctccactcagatgtcacaaaggtgcctctgccttctacaaatgtttgttcaatcctagcatgtctgctttgactcagtgttgcatccctgctccctgcatgatgtctggcaccaacatacttcatatatacatgtcagtggataaattatgtaaacattaaatatctttgtaattaaaaagagtgagaaatgcattcaaagaaaataacaggatgccataggagaaatgagtggttagagatctctctggggaaatgccatataataccccaaaattaacaatgggcctgtgggaagatgaccactccagtcggtgcaatcagcatatgtgaaagaccaggggcaggaagaagcgaaggaaggccagcacggaggaggaggcaccagtgtgaggaggagcttatgacactcgcactggctgctgcctgcagaatggcctggggaagggggagggagaagtggaagtggggaggccagacaggtgacccttccaggagtccagggtctaggcgatgagggcagctggagctagtgagattacaaagacagatcgagaaggaagattcaacaggtattttagtgggaggactggcttgctcttggatgaacttgatatgcaaagtgaggcagaggagcatttcaagaataactgccagggttctggcttgagcaaccgagtggcggtagggaagacaaggagggaagtgggttttgtggatgggaagacaagacccaaactctaagtaagtctgggatgcctgggggacttcgaagtggaagagaaatgtcaagtgacaagaggaaaattccagtctgctgctaggaagagaggttggaactagaaaggtaaatttgggagttgtcaacttttatctaggggagaccagaaagagatggagggcctaagaccatccccaaggagctcagcagaggaggaggagttaaagagcaatgaaggccaggcatagtggctcatgcctgtaatcccagtattttaggaggccgaggcaggaggatcacttgaggtcaggagtttgagaccagcctggccaacatggtgaaaacctgtctctactaaaagtacaacaaatacaaaaattagctgggcgtggtggtgcacacctgtagttccagctactcggaaggctgaggcaggagaattgcctgaactcaggaagcggaggtcgcagtaagctgagatcatgccactgcactccagcctgggcaacagagcgagactctgtctcaaaaaaaaaaaaaaaaaaaaaaaaaaaaaaaaaaaaaaaaaaaggatatggagaggggacaaaggcccaagtcttaaacccaagcacagatccaccctctgtcctgttcttcctcctgggtttcctatccaatggaaccactgaccaaaagtggtcaagccaaaagttaagatgtcatcgatccaccctcctctcccctgcccttgctgggctcctgcttctgacctggatcctgcacttctcccccatttcatcctctacccgtagtgctacatgtttccttcatttacaccttttgtccctgtgtaatgtagcagccacttctaaaagacaaaactaagtattaacatccttgagtttctcccacagcctgtcggatagtgtccaaataactcagctcagtagtacagcatagcaatggccttcactcagagtcagacacaccacactcatgagctgggtgattctggggcaagtgacccaatttctctaagcctcaatttcctcctcttgaaatggagctaaggagaccacgcttcagagttgtgagcctgaaaaacattcaagtgttcaacgaaggcacctctcttgtccctttcacacatgcccctaaaggccaactgtacaaactagttgcattttcccaaagacacaatgacttcacattccatccttttctctctgcctggaatgcccagcccgctccagtcatcttggcaaatgcttaaatacttttaaatctccattcctttaccagctacctcagggaacccttcttatgctcggttttcaccctgcctccaaagctaaatacaccactcccttctctaggcttcaaatccctgggacagaacttccacactgtttctgtgcttcttctcactggactgagcttccccagggaacatttttccagcatcttacatactcagggccccgaaagctgtgcctatggtgtctctggccccccaaccatcagcggagacaatctcccagccccagatgttggccggtgcctggtgctgggcacacagtagctatttaataaatatctgctaagtgaacttgcacgaagtttaccagaagaacaaatcaccactacaacaaaagaggaagagcaccatgttactctggaaggatcaattacactggttgtgcagtactttagcctacacgggcagttcttaaacacaatctgctgtcagtgttgtgtgtgtggttttttaaaaatatagtaactaataaatagtcataataatcctgattttcaaatttaattttaatacggacaatccaaagctaaatattcagattaaaaaaaataatgctttagactttcagttcttgttttttgtttttttgagatggagtcttgctctgtcacccaggctggagtgcagtggcacaatctcggctcagagcaacctccgcctcctgggttcaagcaattctcctgcctcatccttttgagtagctgggactataggtgcctgccaccatgcctggctaatttttgtatttttagcagagatggggtttcaccatattggccaggctggtctcgaactcctgaccttatgatctgcccgccttggcctctcaaagtgctgggattacaggcgtgagccaccgcgcccagccgtttttaattcaacattttaaactcagggttagattccaccaacaaaatcatcttgtgggtaaaagagaaacactttgggaaattcattaaatgatttgagccacactaataatgtatgatttcactcaataatcaagacccgaaaaaactctattttaagagtattttcttgttgatcaaagcagaaaccagagaaaggcagaaaatgcgaagagaagactccagcagctccttgaaatgggcggcgcgcctcactggaagacctaatattgcttctaaatctcaagtgcccttcctccagccacagtttcagggtaaagattagctttgtttattcttgcactgtaaattcttctatctgagatgtcaggagaccctggttaggattgctggggggcatttaaattcattacttggttctagaagcctgaaaagtattttcttctaacacctaatttactaatctataacaatgtatttaaacagtcagaaattagatgagttccagactgaaatctgtgaggacatattcgcatagctttaagagagaaaatgcaacgtgtcgtctatctcatcatgaaactgccaccaacagtttcatagaaggaatggcatcgcttggtaccgaatccttaactggcccttctaggggataatctaggagacggggccataagatttttatgtttttcaaatctgtgcatgggccaaaatactagtgttactaaatttactttcaagtatttaagctagatcttcagaaattcattctacttaatatagctggaaaccaaaaaagggggaagaaacctatttaatgttaatttcaacagccagatgctgatgactgagagcagcatcacgcgctcctcatgaaaggtatccagtgcccagcactgtgtgaggcatggagcaggttctcaatactcatttaaataaggtaagacaattccaccctcatatagatgaaaatgtcactgttataaacaatttggaaacaaatatatttaactattatgaattcgcagaaacgatcttcacatcagtctgtctccataatatccctgttacgtggtactgtaataacaagtttacagtggttacataactagttgctagaaccgatctgctaattactctagcattgggaaatttttagaaaaaccccaggaagttaagaggttgacaggaagcacatgatttaaggagaaagcaatcttctttatcccaagcactagtctcaagccaaacttgaatgtctcccttatttccatctaccttcctatccctttcggccaggccatctaaggcgctgggcagacaggaagcccctctttgcctacagcttccactgtgctctgcgctcgctttctcccgttgtggggtcccatgtccccaactcatgctgagactgggcagcctggcaccacggcctatcagctgtaccttgggacactatgagcgatactagacttatgttaaggaaagccaaggaaataaacatttatcgggtttctctgttgttctgtaattacagcagcagctgctgcagatgcagccacggcaatggcaactctacaacaccacacattcaggcactccccatgtgccacgcattcaggttcacgttgcctcagttgatactcacagtaaccctgagaactaaatgttgctgtccgcacttgtcctcaggaactcaaactgcagtacccaagcgctgcttctcctcggtgagtttccaactattgctaacactcaagatcaaaaaacagggaggaggagaatataatgcaacaacaaaaaccttcatccattgaaagcgagaacaatttaaacacgtaaactatgtcagacctaaaccacagattctaaaatgggacttgagatggaggttatgatcaatggatgtaatctatatggagattaaatgggtaccatcttatcagtcatgatacttgactctacctggacttctcaggttttccccaatttttgctctgctagtacactcttccggacctgtcagctgcaatctagcacacatggaggttcaaagagcctaactggtgctgttctatgaaggaaattgcaggtgcaggtataaactagcattagtgaaaacgatacataattgtacctccaacatgctttggatcaggtctaaagcctttgatagtctcaattaccctattacccatcacccctttagtccaaaagccctgcctgtagctttcaggttacaacccctttttgctggttcactctgcttgcatcttccactactggtttatctctgaggtccagactttcaaaatatacttggaagaaaacagtccttgactttatagcagaaacttatatgacctccatatttgcctctaggaatcctattctcccctgttcctttctcttctgtacttgtcctgtgatttttctgcaaatctctctttattccagtcccagaagcctgcatgctcttcataatgatatcttcccatcattacacatgtacttaagcacatgggtcctatcagctttgtgtcacctgctttagagaggtgcttaccatatgtcagcacgtcacaggcaatcacaatttggatccctagaaactccttcatccattgtcttccaagaaatcactggaaatattaaagtcctacattttcgttttaaaatcccttagccctctctggggtggtggtcttgaatccataagcgcattaaagagaaaacgattttgctgtaaactattacacacaatctcaaagaacatatttggccttggtagatggatgggcttccaaggagaagcagagattgagatccttggtacttggttcagctaagtaactcaaccaaaggacacctcacagagagagacagaaccgggaacattttcagtgccaaggtgagggtacagtgaggggaatgagccaccccgctgctcattcactagcatgaagtcatctaagagaggctctgggctggatgctgctggtacagcaaaatgcctggtgtatacaccccaaagatcatgctcccacaggaaagagtgtccgtgctttaggtggtcacagtgggaatggaaggcgaagctgctggggctgaaaatgggtgtggggtcgccaccccctatccatccatcagctctctctcagcgacttagtgatgttttgcctcctctgtgccaggtgctgcagaaatgacagtgagcaaagccaggcactgaccctgccctcaaagagctcacagcctgaaattctcttatgaggttagaaatccaaagggaattcatctaaagagggcactcactttaggagaaagtccaaaagatcaagcactaacctttaataaagcacaagtcccaggttatagctgaaaactacctccaagcttcccccgtccatttcaacactgtcagcattccccaacgccaaagaggactgaatttagagatctcttcctttggagttccgtagaattttcattcctgcttatgctgtctctagcataatcttttctctcctcccactccatacttgcagtctacttctttcatagtatgtgaactagaggtgatggcaggaattttgagttggattaaaataggcatggccctttaacattttaaatataacttttgagatggatttggatctcagcattatcatgttccaaaaatcataaaggaaatttcataagataaatttatctttgagtttcgctacttgccagtttcactaaacattcggaaggctgggtgggcttcattttatattgggcttttggagactctgtagctgtagttaggctgtattgtaatacagggctgaggattcagatcacaaagcccaaacatttggagctcaatttaaggttcaatgtataattctgacaacattccactctattttagtctcaacttgcacatatcaggccttgtagatagtttcagggcctctggttgaaaagaaaaggccaagtagccagataggcacacaaattccaaacaaaaggtataatgatgagaccaacacacctgaggtagctatgtaattatttgtctacaaaatgtgtcttaaatacaagaaaaaaatcctccttggaattcctcagagttgaaaatttaaaggtgactcaaaagcaaaggagatgtcatttagcagatcagttcttaacaatttccttagaggactgtgtatcacaatggcactattggaaaaggtagtggcataccttttaatatgcggtgctataagtgctatgcataaaataagaagcaatgtgtaggcagtagcaattaaattgcttatgcactcaaacatttgccttgaagtataataaaactgagcatgaaatgaaaggttcatgcaggcctatgagcaaaacaaaaacagaaacccaaagcccaccccagcccccagtctacccccgccctccccggccaccctgccagtccccccacacgtttttcctgtgggcttaaaacccttctgttttggaagacctacaggctttatacattcacctggtggctcatgaagaccagaaacactgtcatagaaagaagctctctgaatattctgaatctctaaagcagagaaacagcaaaaacaggacagaagagcaaatacacaaacacttcagttagtgtgaaagacatttgacagcacaagtcaactttgaaatcgggctacaaaaggagctagtccaaggcagatcccatgcaaacatgactgtttagagaatttgcacatttggataaagttctttataaaatagattaatgctaaatcaaaagagcacattcccaactcccggtgtgagcattatatgatatcaatgtcaaatgattagcccatgtaaatgcaagatgacatttatgaggaataaggcactatttgagttgtctatcgtaaaaatatcttatcgttagtagcttagggcatgactgcagtgaagtcacagcactatggcgaatgtaagtatcaatggcttttactgtcaaaaattacgctgctgtgtaattaattttacttctaatacagattttcggaaatataatttccgaaaaataatttgaatacaaattaccatatgacagataactaccattaaggaaaacaaaattcaagttctgttgtagcaaaatgttaaaataattttgaattataagcgagattatacttattgatcatactgttactcatgaaaatatcctaggaggtacattgacatgaaaatgcaatctttaggatttttttttttcctcaatataagctttaagaagtgccaagaagtcctttgcagctggtaaagagatcccaaacaacatcttttagcaaaaagtagggcattataaatctctagggcagggctgccaccaataaatcttatttctcctggtttggccttgagaaaactctaaaactctaacacaaactctactttttttctttttctttttttttttttcagttgagacagggtctcgctgtgttgcccaggctggtcttaaactcctggggtcaagcgatccttctgcctcagcctcccaaactgctgggattacaggcgtgagccaccgtgcccagccataaactctattttaacacaaaatgtttcatactgtaggtgttgcaccttcacaggcaaactatattcatatatcatatattcatctattcatgttcaacttgtcgttttctgcttttgcatttaagtggctctaaaaagaggaaaataatgtttttccagggttatttttctagagaaaaattgctccccttatcctgcgatctctctatccagagtgagcagtgataaatcctccaccttagaaccctctttaaccttctgtgcctgccactgctttctgtatgaaacaaactgtcctcaaaattggacaaacatggtactgcttctctgcctgctcctcaccctgaagaacagtgcctcccaacagtgagtggcctctgagatcttctccgtcactcagatgaaactaactgtccacctaagctgaagagcgacagcacctcctgctaagagcagcattatcaggagagcaaacatgtaggagtattccagagcagaggctagcagagccaaagcaaacctggggtagataagatatcccttggcttattttgacaagaatggccaaatgcactcccaacggcatatctctggaaagacaagggccataaatagggctgtgcaaacatggcatctgtgagtcagagctgtggactaagtacagatgaatggggctcacaccagggctgaaggagctcagcaaggcttacagtttcctctaagcatttctgtaatgaaatcaataactttcccgtatctcttaaatggaagacacaaaagtgcaggtaaggagtctccagacagggtcctacctgtaagacatagcatctgtgatctgtaatttgtatgacatcccagcctcccacctccatccttgcccaccaaatcttatatacctacagcttctgacctattgttgccaaagccctctccagtatctggggctggtgagaccttaaattaaagaagaaaggaaggaggaagtaggaagctgggagccaagaaaaagattagctcagttctagtaatgcatctgtgtatatcctggtttctcaactggatcactagctcttgggaggcaggggacatgtctctcattgcttccagatctagctcacagattattgccatgggaagcacatacttaggtatgtagaattatacaaatgggtcaagtgctgaacaggtgtttccaacaccatttttggttaagggatataagacaaggactaaaaaagggttcatagtgtcagaataaatatgtaataaaggacttaatttccatgcttataatgtcagtagtcccaatacctgttttccttcaaaatgaagagaaaaccagtttttgaggcttgttttcaaaaaccaggaaaaaccccatttcctctgttcctgtttcccaggcatcatctccacgcccactgtcatcttcagtcgccccatattcaactcctcacttccaggctctttcactccaatctacccaaaacacactgcctgtttcacttcttcgaattcagaatgggtcactacccaaggtcacaaacctactgatgctatttattcagcacagtctcaagtccaaattccactagagatgggacatgaggactctccagtctagcctcaacctaccatcccagcctcatttcctgctcactcttctctgccccagccctctctaaagccaaatggaacactcctcctgagctatgattttccacctctccactgtgatcattctgtacttcttctcctgccaacttcatttctacaaatgccaccccagacactcactcctagagtcagttcatgcaaaccttcttacccgtttaaggcataaccgggccataaatgctcataaattagtgctgaaaacactgtgtggcacttagtaggtgctcaggagatgttagctttcattgtttaatcaacaaatcattattctcttttaaggacaaggaaaatttgcatcctctcatcatgacatttttcccttagcgccccagaaaaaggtagtcccttcctctgttgcacacccctaaaaattcactgtaccattcccatggcatttatcacagatccactttgcatactgatctcattccttctgctgtgttctaagaccttacaagggtatccagaggagaagctgaacatggggagactttgtaacctacacagtctccaacactgtcacagctgaagtgattcctgaaggaatgcaaatccttacgactgcaacattactcctccctcttcttcctcacatatttcccatccacatttccaactcaccagcgctggcctttctagcactgtagaccccgtaacaacaacctgagctcagaggtctttttctgttctcgtctcagtttctcatatcccactcttaacactgcctgttgacaaggtgaagaggagctcaactctgaggatactgtaagttctattgcagctccctgcttctcttcccagtcctcacacagcatccctcgactgactaggtcactggaagtgacactgcactcagtagtcagttgaagactttcacctaaaggtacaaagattaaaggcttctgttttacttgttggaaagctcgtctttcccccaggtccctcccctctttgctatgtctcaggcccacagtctgctcccaggacgcatgcgtgcctgtgttcagtgcatccccccctgcagctccctcacactgacttgatctgatggacacagtcattcttaagatgatcttttatagggtcacattccccctagtcactttctctgtgtccattcttcaattcctgtctctttcctttggccccaattgccctcagcctgcctgcttccatttgcccttctctgcttccattcctttccctctacctctaagacagctagattacaaggcttaagatgctacagagaaagcagatgtgacccaggttactgaacaggtctggcctcagggtcaaggtctaggcagggttagatccagggctaaggtcctgcatggcctgaagccaggcaaagaggtggaacagagccaggatgaaatgtagcaggtgagctgagctctaggagaagatactggttcctaaaatgcatagagacacagagacattttgattttctgatactagtaaaatcttctagtctacaataaaaatcaccaaaattcttcaactgaggttcatataacaaaagaactatgaggactgatggaaagaagagcaattgatctgtatgcaggcaatttgagtttatccaccagccactgggtgtcgcggcgggtgcgggtggtgaggaaggacggagctcagcaggcctgacacagggaaaatggaatgagcaggccttctcgggttttgtgttccagtgttcctggattacaactgacttgggactgtggtggcctaagtcatacgtgtacgtctttgtggctccgggcctagaatgtttctgtactcctacaacatctgaccaagaaggtagctgtctctgtattcatttcttaacccaagtattgttaaaacggataaattccgatataacggcagccctgctctagggaaagaaagattttaaagtaagaagttatatgtatccatatatatgtaaaagaaccatctataaaccttaattataaaagattccagccaagcatgattacaaagataagcactttcttaccatctttccaaagctctgccacaaatctgtctgatgactggtgcaaaagggtggccacgttgtcattcagggggtccatattcttcatcagccactcatctgccttatagtccacctatcccgcaccaaagccaaaagtggtgaaatggagaacacaaaaccaaatgcaaaaacaaaaacactttaagcctcaaccagaaacttttatacaacagtccccaaaatgggctgtctgaaagacaatatgtttgtaatatatactgtatttgtttataaatgtttatcagcacctttgttacaccttcataaaaatgtagcaaaatttcaaacacagccattttaatccagttattcaacataagagctcttaccttccctgcataatgtataatgcaaaaatcagctttgtcttttaattgtcgaggtttctgaaacttggagtgggaaccttgctcttgaaccagtttttcaacaaaggttttatctgtggctttagggaaccagcattcttcatccaaaagggccagtacaccaggagggttcgcctgataatgacaggcaataagaattcacaagttttgcatgccactttaatactactgagtctggcacttaaacttctaaaacaattagttttatgaagatccatggaaaacaaattgctaggatggaaaggaatgtctaagccataacaagtttataattcaaacactgacatctcaaactgctaaataagtactaacaagaaaacagaggagtaacttatctcaaacttacaaatactgtatgtaaattgcaagtaaatgaattccaagcagatggccccacaaaagtggcaaataaaagaagccagaaacgcagtgggaagtggagagatgaaactgaatgttcatgttcagtgactggctggagaaatcattataacacctcaactaatgagaatgcttcaaacattttatatcctaatcagtttaagtttctgtttaagtaattttaaattaaatgtatcactttatatttggcgaaatattttaaactattattaagtagaatatatggaaattgataaactaagtcagtcatcaattgccttatatatttgttttaacaggcatttgacaacccattttatgtgatgcaattattacttcattgaaaaaaagtagcactttgggaggccgaggcaggtggatcacgaggtcaggggtttgagaccagcctggccaagatggtgaaaccccgcctctactaaaaatacaaaaattagctgggtgtggtggcacatgcctgtagtcccagctactcaggaggctgaggcaggagaatcggttgaacctgggaggcagaggttgcagtgagccgagatggtgccattgcactccagcctgggtaacagagcaagactctgtctcaaaaaaaaaaaaaaagcgctagatgaatccatagagacagagggtagattagtggcagccggggattgaaggaacagaatgtggagtgaccactaatgggtatgaggtttctttctggggtgatgaaaacgtggcaggatttggtagtggtaatggttccacaactttgtgaatatactacaaacatcactgacttgtagttttaaaagggtggatttcatggtttgtgaattatgtctcaatttttaaaaaggcctagagctcaccattgtctggagtgacttcctttttggaggtaaatgacacatgaaagctaaataagatatttaaatagtgatggtctattttctagtgcttctgggccatcatttattgtcacactgcaaatatggcaagtgtgtgatacaaaactgaactcgtaccagttctagggcacactcatgaaatcagctgtttgagtaagactctaagatcagttctcatcaactcacaaagctttcatatttactggcaaagagttggcaatacacacaaatgctgtttttaaaagtagctagaggctatggttaaatataaatgaaacagtgtaataaagtggtcagagaaagggatgggtgatctgaatgccagcgggtggaagctgagggaacccttctgcaatggagacccttaccccagggctcctccacctgaaagaattgtcagggtttcagatcagctaaaaagaagacagtaatctgaagcaactgggattaggtcactttagaggagctcagagtggcaggtaactcaatccaccctaatcacacaacaactgtgagaaaggaagttccacattaatattaatataacaaaaacatcctccttttacccttttacattcttaaccacttttaatgagaattttcctaaattctgacacagtatctcaaataaaaatttgtatttttttctaaatgacttggtgacagcatgatcatgaatatcattactgtgtctccttttcattttttccacttcatccttcaatgtcaagatctctattatcattccttctctgaaccgggtatttccaagagctgtaagcttagaagcctgtgtttctgaatattggtcataggttttgtgaaagcttgtgaactcagaggcttgcctgccaccagcccacagtctggcaaggcaggggctgggattatgcgagatgagctaagcctggcacgggcctgtcaggtgccaccacagaggatgtttttacagcattttccttctagaaagtattgttttcactctccattttgcaaggaacatcaatgggatcattatcccatgtcattccacaggctgtcgttaaattccccatcatcataaactctcatggggtttacaaaatgttatgtttttattttttattattattattttttgagacggagtctcgctcttgtcccccaggctggagtgtggtcacgcgatcttggctcgctgcaacctccacctcccggcttcaagcgatcctcctgcttcagcctcccgagtagctgggattacagacaaccgccacgacgcctggctaatttctttttgtatttttagtagagatggagtttcaccatgttggtcaggctggtctcgaactcctgacctcaagtgatctgcccgccttggcctcccaaagtgttgggattacaggcgtgagccactgtgcctggccatgtttttattttttaatcagatatttctatgaataagtagaataatcctcaaattgaggtaaagagtgagtcagcattaaatcttgaattccttccctcccctttctgagctatctctcctataaattaggactatttaggcagggaataaagggtccactctaaaggctgaaggaagagcctagaagtgccagtacaaagaggataggaaggaaagaaggaacgagttacctagttctactcattgcccgtcagtgtctgggcataactggtgactaggaacatcatgacttcccagctccaatactttctgaatgccctggctgctgtggtttcaatgtgttccctgaaagttcacatgttggaaacctggttcctaatgcagccgtgttgagagataagacctttgggaggtaactgggtcatggggctctttcctagtaaatggattaattcattcatggatcaatgggttgttgaggaggtgggttagttatcatgagagcgggtctgtcataaaaaagccagtttggccatttcttatgagcccccccaacatgtgatgccctgtgccaccttaggactctgccaagagtccccaccagcaagaataccctcatccaatgcagctcctagacctgggacttcccagcctatagactacaagaaatcaatttcttttctttataaattactccatcttacttattctgttatagtaacggaaaacagactaggacactcgccaaataacttccctaaaataccactttcaacgtgctgttcacctgctgatttctgaccataaaactcatccctggaatgctccctgcacagcatccacgcctgtaataccttccacaacactgccagcctactttgtggcctttgcctttttccgaattcacagagcatcagttagagtcatacccaggaaccaatgagctcaccactatgttgtgttctgttttctggcttcaagatcaggttcttgaggaccaaggccatgctatatactatctcatatccccatggcacccccaatctgcatttccaggccataattgaggatttaataaattcttttctttttttttgagatggggtctcactctgtcactcaggctggaaggcagtggtgtgaccgtatcactgtagcctccaactcagggcctcaaaggatcctcccgcctcagcctcctgagtagctggtactacaggcacatgacaccatacctggctaattttaaaactttcttgtagagatgtagtcttactatgttgcccaggctggtctcgaactcctggtcttaagtgatcctcttgcctcagctttccaaagcactgggattacaggcataagccaccacacctggtccaataaattgctatctggatcttattctaccaccacaatatttacacataaggcctggaaaataattaaaaatgtaaacatcaaaccctttctacttcacttatttatttttttgtttggaaacagggtctcacgctgtcgcctagactggagtgcagtggtgcaatctcggctcactgcaacctctgcctcctgggtttaagtgattctcatgtctcagcctcctgagtagccgagactacaggcacatgccaccacatccggctaattttctgtatttttagtagagatggggtttcaccatgttggccagattggtctcgacctcctgacctgactcaagtgatctgcctgcctcagcctcccaaagtactgggattataggcgggagccacagcacctggccttctacctcacctatttttgcttggagttggttattagggttgaaatgtttaattactttaccccatgattttcacctttagagtacaattattgtgtgagagtaaaaaaaaaatatgcaaaaatggtatataaagtattttgtcctagaggataaagcaaaagaaatgcaattaagtaacattaagaagaattaatatttgtgagactcatttaaaggtcacaaaaccattagatttaaaaacactctaaaaacatttaaaaaattaagacaggtaattttccatttggaagactttcggcacaattattcctataaagatactgacctagcaaattttatgggttctcgtccatcctaaaataaaactgcaggtacataatcattatattcttaaaatgtaggacttccagtgtcatatggacgcatataatgagcatctcaaaaaacatatcatatagtcatcaatagtactaatgtgaaatactcccttcccttatttacataaatgcccaaacaattctttaggcaacaaagcagtgatgaaatgtaatgaagtgtgttcatgtgcttgtgtatgcacaagttacctggaagtcactacaagcatgccacctctaaatgaccctataagctacaaagaagcaactatcctcacaactataagtaatttaagatttttgctctaaacgtgacttgaaaggtaaaatgatttcttatgtattataaaagccaaatgaaaattttctattgctttccttaaactcaaatttctaatgtgctggaactacatctctaataggggtgaatgtcttctaggttcttcctcttcccgatgtgccactgctcctcctgactgcaggtactgtaccatccatgatctctagccattagacctccaacaccttcaaacatgaagaacacaagtggcaaccagagattgagcagcaagaaccagaactgcttcaaagcctgctgcacctcctaggagaaaactctgcgttattcaaacatacctacttaactagtgttagagcttcctctacgttacagatatcggtggttaatcatgttttagtttttcttatattttggcagatagcaaaataaaataaatgaagctgacaccttgttgagcaaaagctaactgataaggagtacagaaccagattgtcaacacttgcttgagatcacatggagctgagttccaaaagtgaatgagttatacactcgaagcttgaacgtgaatgagttctatgtatttttacagaacattaaaccaccaagaaaagagtttctgatgctttctaagattgccactaaaaatacatctgacaagacttccctgagaacaaaaacttcaaattaaaaaaaaaaatctggcaaaataaaaacatctttgtactttaaaaggccaaactttagttatctgcaaaatggatttacgtgacacgtcttgttctcagctaaataaagtgtcaggtggagctccacatcctttgaaaggtacacacaaatgccagcgcacagggccatctgcagtctgtgcgagccagagcccactatccagtattcccatgcaagcaaggacaggaatcaagctgcgaggagagctaaagaagggttttactggcatgctactgacttttaaattctgtagctattttatcagagtatcaccttcctagaaaatttagatcagaaaattatttcaccactgaacagactgggtaatttctgtcttgggttatgccacttaaggtcactgcttgagtggaaaatgaaagacagcgagcaagtgagcactcttacaggtctctctattaggtcgatgcatggctgcagatccagcccgaaatcgatgaagttccactcgatgccttcgcgctggtattcctcttgttctaggataaacatggtgtggttgaacagctgctgcagcttctcattggtgtagttgatgcaaagttgttcaaaggagttcagctacaaatgtcaaagggtaattttccaaacatggggaggtggagggaaaatgggaataattagttatgtagttataaaaaaatttttcattaaacattactaattaggtaggaagtacatgattgcttctatctaatgacagtgactaaaccaaggggggtggtctcccaatccctctctcacacacagcctttttgaaaaggtaaagagaaagaacatactgtctatggctgcattactgaactgctaaaatgaaaagataataaacttaatatgctaactgaatgctctgcaagtaaaacaattcagttcttattagtgaatggttaaggactataaataaataaatgagacagtaagaaaaagaagaaaaacaaaggcttggaaaaaccagaggcaaaggaaggcgaacaaggtggtgggcgcgcttctgaagctggggtggagaatgcatttggttctgtcccactccactgtcactcaggctgtgggctctaaggtgaggtaggaaaagagtcatctttactgcatggaattgctgagagctcagccaggcctggcacatggaatgcgcttagtatgagactctctatcgtttctctaagcattcccttcccttatcaaatgtttgacctttgcaataccaaaagtgatattggactgccctcataaagtgaatttaggcatttttcatatgttattgtcatttctgttccttctctgtgaactctgcccattttttaagagaaaaattgattgggcgaatgcatagatgggtgaattaataggtataattttcttaatcatcctatacactagaagtgctcaacctctttcctgcttctatactgttcacacagctgcatgtgcccataaataacctctttcattataaaaagtgattttcaattaaagaggatttaacccatctccaaggagttgatttacagtctgaaaaagccactccaatcttttccattctccagaagctgttaaattcactatttcagaatgaggtcatgcaaggagggcaggggcagtgcttgccttgctcaacactgtatttctggcacgcatgacaagcctcatatttacagactgccggattctgcttattcatgttcatgtaggtgaactttgctttgcctcaggatgatgacatcctattgctctatttagcctgggccattacaaagaaggttttttttttttttttaggagtctcgttctcttgcccaggctggagtacagtggcacaatcttggctcactgcaacctccgcctcccgggttcaagcaattctctgcctcagccttcggagtagctgagattacaggcatctgccaccaagcccagctaatttttgtatttttagtagagacagggtttcaccatcttggacaggctggtcttgaactcctgacctcgtgatccacctgcctcggcctcccaaagtgctgggattacaggcgtgagccaccacgcccggccaagaatggtatttttaaaaatgaatttctacttgtcttccatatttaaactaccaattataattttaattgatttttaaatcaataatgcatggtagaaaattcaaagtgtacaaagaattgcaccagtttcacttcaatgaaacttacttgttctccctattatcaaccagtatctcctatttttgtgatctttccagaaatatgctatgcattaagaaatgtgtgtatgtgtgtgaccctgattttttttaacttaacaatgtatcttgttatgttgtgggatctttccttagtgtataaagccagcccattctttataatggatgcatagtattccactgtatggagctatcacaataatttgaaccagtttcctaaaggtgggcatttaggctttttctttccttttctcatgacaaataacactcactgaacaacttagcatttttaccatctacataaatgtcacattttcccatcgagaacagggtgtgtctcctcacttgttcaagtcttcttttcttttttgcagcagcactgtaaagttgccttcatttaaatcttgcccatttcttttaaaatttatttttaggtgttttgtctgtttgttgcagttggaaatgtgggtcttttctttcactatatcttctgatcgtttatgtagaggaaagtgacagatttttttaatgcaatttgtacccagccacttttcatgatttcttaatatatttacaaatcaaaacaccttaaagcaatctcttagagtggcagtggcaggttcagtatttatgaggatagacttataattttaaaggggttcattttaaaataagacaattcaatacccaatagtggctacagtaacacacagatgatcacaaaaagcacttaatatttgtgccgtactatatttacatagtttacatctatatttatggaaataaagatataaatttttagatgccccaaattttatgcacctccctgaaacaccgtagcaggtgtgtgactgtgaaacttttctgcattgatgatgagtaagtatttggataaatctagtcagatcaacagtgaaatctattgttaaaccctggttatatctgcagtacacagatcactgcccgtccaggtgcctccctctcactttgctcctctcctgattccccagccaagcccccgtcatcttgcccgtgttctactacagtggcccccttgatggtctctcgacctggccccatgctcttctccacgtctccaactcctctctccctctggtcagctatatccagtcatactggctttctagcagcttagaacatttgttaagttctgtcccatacaggaccactggaattactctcattatgccgggaaactgaccgaggctggcagcttctcatccttcaagtaagcctaactgttgccaatgcagaagcaaccttccctgaacagctatctcaagctggcctcccagttctatcacagcaccctttcagtgcattctcacagacctgcggattcactgattatttgccatttattgtttggctctactagaatggcagggactgtatccctggtgcctcgtatgtactgggcacacagtaagccttcatatttgttaaaagaacaaacaaaaagaaggacgagctagaggaagagggggaagaatacctcaaaaatttcaaatccagcaatatccaggattccaatgaaagatgctccctgacgtttggtcctatccagagctttattgatgcgatgaacgagccagcgaaagagccgctcataggtagcttttgccaatgcttctactgcaaaatctgcctgtaattaaatcacaacaaccttttattctggaaacaatctcaacaaagcataaatagctgttttacggaatttaatgttatacagcactcaaaaaacctgagatggcattcactgcttaatcatgtctcaattttacacatcaatagaaggcaatattagaagaattaaatgaacacagggaataacgaatttgggggatgggtaaagacgcctaataaaaataagctcctccccatgcgcctgggtcctgggtagcactgtccgcctggattcagctcagttaagctggtactttctctctgctgtaccacccagcacaaggacaaggcggcaggggcccttgtgttggtctggttcccgaagtatgcagatttgtctactggattatctatctacctggggaaaactagagattataatttgacatttactttttttaaaaaatcacctttaaaaaaattttttttttttttgatacggagtctcgttctgttgcctgggctggagtgccgtggtgcaatctcagctcactacaacctccgcctcctgggttcaagcaattctcccgtctcagcctcttgagtagctgggactacaggcgcatgccatcacgcccggctaatttttgtatttttagtagagatggggtttcaccatactggtcaggctggtctcaaactcctgacctcaggtgatctgcccacctcagcctcccaaagtgctgggattacaggtgtgagccaccggccccggccccttttaaattttttcgaaaacgaaaaagtaaatatacttaaaaaaaaaaaactcatttagtacctaaaaacacccatgtaagacagtttatattgattcagtttgttacatgtcaatcagaaggccaaatggccatggcttatcattcaaacaaatcagtaataacaatgaacatgaaacctacctgttctttggtctgggctttttgcacatagtctcggccgaccttgatccggggagtcaggatggcccgagtaaactccatcacattcatcccaagaagatggcagagcttctgcgcaactgaagtgtaaaaagtctcctaaatcctacattttttacttacaatctactcacaatatattcaataaacactggaaaaaccttagtaacaattaaattgtattaagaaataaataaaagtcttaaaatcagacaagttttaggtctaatgaaaaataccttccatcttttcaaattaatacacactcatttttaggctacaagagatggctagtcagcatttgactgccttgcctatttattcatttttttagaggcaggttctcactatgttggccaggatggagtgtagtggctattcacaggcatgatctcactactgatcagcacgggagttttgacctgctccattttcaacttgggctggttcactcctccctaggcaacctagtggtcccctactgctgggaggctaccatatactgatgctgaacatagtgtagacaaccgacgggcatagcacgacagcctagaactcctgggctcaagccatcctcctgcttcagcctcccgagtagctgggactacatggccactatgcccagcctccttacctttacaagagtgacctgatcctcctctatttatgggtcattaaaaaatttcaaagccaagctatactaatatatgccttactctgcattttagatggctccattttaagtctatttaaccatggaaaagccatacggaggatggaggcccaaccgccaatcaaactactttgactgaatgacagatgaatggtcctggaaatcaacagccctaataggaggtgccacagcttggccagaaaatggtgaccaagaagcagcaggagaggcaggccccttagaagagccacacagaattaaattgttatcaagcctcaaattggttataaaaaacgattatttcaagggcagataatgtgactttatgtcagccttcacccgccacagtggactgcggatgcctccatgaggcaagataactaacttgttagaataatcaagcagtcaaggcaatatagagattcctcactttttctctccagaccatctgaagcaaactgatatatatataatatatatgtatattatatatacatatatttaataaatatatactttatatccatattatatttatatatttatattaaatatatatttaataatatattatatatatatatttgggtcacaaacttttgttcctgaccaatgcaaatttaaaaccattttcgacatttaaaaatgggaatatttcctattaagatctagatttccatttttctttgaaaagtcacttatatttggcaatactgggcctgtaatcctggcaaggtgcacactggctggaactcggcagctgcaccaccctctcaggtaagtgtgtgacctcctgcggctgagttctcctccctcaattcccaaggcctcctgcatgctaaggcagagaccactgctccttttcatcctacaccctgtcccctgtcctcatttatagaatcagaggaaccctcgtgtaaatacacgatgttgtcactctactcaagggtcccttcagaaatgcttcagaggtgcttttacgcttgcactgtaacaccttcttagagagcacaacaagccatcgaaacagaaataaagtcagtattcatcagtttacctgtattttctggcatggaagcttgatcagtatttctctcctttttgaaagaaatatttccaaactgtagcactgaagatactactttaagcattgcttcatattgataaaaagaaaaaaaaaattaatattgcctcaaaatgtagcggagacatattctcatttattttgtgctaaaaattagctatacaaaacttttcagtaagacatgtcttttcaggatttcatacaattcattagtttcccagtcattttctagtttaggtgatttaccccagatgtataagtcttaggaaagtgagtaccagaatcttagagaaatcacacatacacagaatctcttcatgggagaagcccattatgtgcattgcttccatggtctcctggaaattatctttgtcttgctgtcccggaataggaatatagccattggagagaaacctgtagttattaaatccttcaagaagcaaatcagctaaaaggaaatataatggaagaaaatttgataaatactcatgaagacaactaagccataactgcattcaaactgtgccagtgtcacaggagagcagtggtcaccatgcaacccattgccagcaaaatgttttttttctttatatattcatgtaaatacacaaacatacatttttttaattatctgtaccaacaaaggaaaatgatgatgttaacaacgcaaaaaccttaacaggagttttggggatggcagtttgtacaatattctgtttgaaattggttatctgcgaaatgatgtcaattgtccagatgacaaaactctattgttttcagatttaaatattttagccctcttttttgaaggaaagcttttaaactcatattctatattcctatcttagcaagtagtttgcagcaaacactatgaagtgaatatgaaaactaccatggacataagctaaagatacagtgatgtggaccaagcacgtcccgagcccagcaaaggccctgaaacactttctccaagccagcttgcttggtggttaagttgcctttagaatgatgatgtgatgtggcgcagcagactattgtaacaggtacccgcactgactactgtaccgtaggagacatgaattaaagagaacttactcttttgacaaatgcattcttgagagccaaagaatatttctcaggagtgctcaaaatagcagggctatttatcgttataacagatatgcaaatatgctcccagctttctttgtgactggctctcttgctctcctgcagagaatttctgcaggtcaccctgtcccgttattcttgtctacatcacatttaacttctacagggtactgcctgctgctttctttttctatttctttcaacactttgatcattttaaagaatttactcgctctccctctccctctccctctctttccacggtctccctctcatgctgagccgaggctggactgtgctgctgccatctcggctcgctgcagcctccctgcctgattctcctgactcagcctgcccagtgcctgcgattgaaagctcgcgccgccacgcctgactggttttggtggagacggggtttcgctgtgttggccaggccggtctccagcccctaaccgcaagtgatccgccagcctcggcctcccgaggtgccgggattgcagacggagtctcgttcactcagtgctcaatggtgcccaggctggagtgcagtggcgtgatctcggctcgctacaacctccacctcccagccgcctgccttggcctcccaaagtgccgagattgcagcctctgcccggccgccaccccgtctgggaagtgaggagcgtctctgcctggccgcccatcatctgggatgtgaggagcccctctgcctggctgcccagtctggaaagtgaggagcgtctccacccggctgccatcccacctaggaagtgaggaacacctcttcccggccgccatcacatctaggaagtgaggagcgtctctgcccggccgcccatcttctgagatgtggggagcgcctctgccccgccgccccgtctgggatgtgaggagcacctctgcccggccccgaccccgtctgggaggtgaggagcatctctgcccggccgccccgtctgagaagtgaggagcccctccgcccggcagccgccccgtctgagaagtgaggagcctctccgcccggcagccaccccgtccgggagggaggtgggggggacagccccccgcccggccagccgccctgcccgggaggtgaggggcgcctctgcctggccgcccctactgggaagtgaggagcccctctgcccggccaccaccccgtctgggaggtgtgcccagcagctcattgagagcgggccaggatgacagtggcggctttgtggaatggagaggcgggaggggtggggaagggattgagaaatcggatggttgccgtgtctgtgtagaaagaagtagacatgggagacttttcattttgttctgtactaagaaaacttcttctgccttgggatcctgttgatctgagaccttacccccaaccctgtgctctctgaaacatgtactgtgtccactcagggttaaatggattaagggcggtgcaagatgtgctttgttaaacagatgcttgaaggcagcatgctccttaagagtcatcaccactccctaatctcaagtacccagggacacaaacactgcggaaggccgcagggtcctctgcctaggaaaaccggagacctttgttcacttgtttatctgctgaccttccctccactattgtcctatgaccctgccaagtccccctctgtgagaaacacccaagaattatcaataaaaaataaataaataataaatttaaaaaaaaaaaaaaagaatttactcctattgcagttattgccagtctgaaagcctgagcattttcttctcttcagtgttacatactgcatcatcttgaatttttagtctctccttggcaataactctatttttttgttgcttgatttttcccttgcaggtcattctctgattaatttttgggttcaaaggtttcacagatgtctgtggttagcaaaagcctggatgccagatgagaaaacttttactgtatatgtgtctactttgatatctagataatatatataataatcatgcagaaacactaaatttgagaatcagaagagatgggaaagttatacatcttctcctctccctcaatatatttctaacccagcaaaattctgacccagacctgagctctcctttgtacctgcccaactctaaacttctagtccttgtgatccctgacattcaatcaatcaatatccaccacaggctctttctagtactagtggaagcaataacatatattcagttgtaaatctagaaataaaaatatttattctacttaatttcattaggtaaatttcttttcccttactttcatattttaaaacgttgaaacagagttgtaaaatacgcatcatttgtcttctaatttaaaaaattttaaaaaagaaataaaagtacaaaagattatattatctacaatacctgccgcttaaaataaagtacttaccccatggcatggaagttcaatttcattttgattttcatgatttaaccagctggaaatttggtgttttgtgtgtaaaaaactgtttcccaaaattgttttttctcaaaaaaaaattaaaagagatattccagtgaatataaaatagtaaaaacctttgtaacttacactttaggtgttctcctgctccagataacaactggtaaaagatatgaaaagtacgttcatcttttgcttgacgaacagcacgagacttttccagaaggtctgagcaaagacagttaagaattaaattatttaatataattcttaaataaataaaggccctctttcagcgtctgtaaatttaaatcataaaacatcttctttctctgattattatataaactatcctgcaatgaactattctaaatgactgtcttccatctgtgaaaaaagaaaataggtgcaacttacgttcctcactgatcttccagaatcattggtctgggaaggaacttaaagattatacgtgcttccctcactcagctccactctaccccatccttcccctaacttggattacattcaaagaataccacactatacgaggaactgtaagaagctattgaaaatgaagtacagttgtttaaggcaggagaagctctataataccagattaacacaattttataaataaggaagccatggtataaggaaattagtcaaaataatatagttaataagtggtacagttaggaaccaaaaacttggcttgactccaaaatgcatgatgagagtgcccacaatgctaccctattgaaagcctcctatatgagaggcactcgcccttcacactcagcagcacatgtaactttcccatatgccttgacagctacgatgagattaagcactagtcttccctctgctgctctgaagaaccggtgcggccagtacctacgcctgctgctacccaccctgcctgggcttcccagggggcaggtggcacagtccccagcagctcctgcatttcagaccactgcacacccagctgtgtatcttatctggggctcagatccacagttcttgatgctcccggagttcctatgggttgacagtcacaccggcatctcagagaacgtgtatcacagctttggaagatgtttgcctctcttgaggtaaaccttccctggggccaccaaagtaaattaattctgtatgtgtcagatagcctgaattttaagtcagactatcccacacatcctccacgtctggtgaaagacacactcatatgaatcatgctctgacacacctatatgaagaaagctgaactgcagattcattctcctgtcattttcaagtatttccagattttgctggctgtgagtccatttggaggcataaaatactgttcttaaccagaaaatcatggtctgtcccttgaaggatagaaataatgtatttctatcactggagattattctattaagtacccgaaaactgtcatctatctttctaattggcacactatcattcagaatcatttctattttattacatctatactcaaatgtgttttacctgggtatatatgtgcatacacatatataaaccttcttatggccattctatgcaggtgacatttcttaggactattctatgtacttgacattttatttttttctccagctttattctacttaacactaattgagattactttaactctgtaatcttataaggatgttttcaatgattacatgctcatccttctaatatcagaagtagatggtaaaaagtgggctaacagcaatagggggagggcaactgcattcatctgaatgtcctatatcacacaaacactgtggcactctccacttccccagccatgtgaataagttatggcctggttttacaaacaacaaaacaacttggagttaatattcactagtcgaaagtatttgaacaaggcatgctatctctgggctcaagttttatcatctggattttgggagtgatatcacagacggttgccatggggttgtaggaagactaaatccttctttattttggattatacatttatgaaaaaggatacatgtttcaatgttggccccaacgatatagccagttacatcaaagttgatccgaataaatttgccctgaaaataaattaaaaagagaaaattgaaaataagtaagtacatactggatatgaacactaataaactaagaagacaacaagtatccatgaattagttacaataatggatcttatatattgcctcaaacaaaaagaaaaaagaagaaaacaggctgtgatacatttcaaaaaagtagcaacagaataggctattttcctggactataacataataaaattagaaattattaataaaagaaagtagtgagatcccagtcattcagaagtttttaaaagctcttctaaataatctgaaatatgagagattttaatagttttaaaggaccactctatccagcactataatggtagatttaaaaatctgaatagtataaatgatttcctagaaaaatagaaatccattcaagaaaaaaaaaacccgaaaacttaacccataaaaataaaaaatagtgaaacagaattatttctttaaaaatgctggattagtcttatgaaacaattttacaaatttctaaggaatatttgatttctttactatacataactgttttagggaaagaggaaaatcgtgattatttcatcattcattttataaagttgtcataacactgagtacccaatctgataaagatattacaaggaaagcaagctgggcgtgctgactcacacctgtaatcccagcactttgggaggccaaggcaggtggacctcctgaggtcaggagttcaagaccagcccggccaatacggtgaaaccccgtctctactaaaaatacaaaaaaatttagctgggcatggtggcgcatgcctgtaatcccagctactcgggaggcagaggccagagagtcacttgaacccaggaggcggaggttgcagtgaactgagatcgcgccactgcactccagcctgggtgacagagcgagactccatctcaaagcaaaataaaagcaaatatggtatggttatatcttacttataaaaatatatataaggagaatcgcttgaacccgggaggcggaggttgcagtgagccgagatcacaccactgcactccagcctggtgacagagtgagactctgtctcaaaaaagaaaaaaaaagaaacaagaaaaaaaaattaaacatgttaaacattttgcaaaacaaacataatgatcaagaatggtttattctaggactgctaagaaggactgacactagtaaacataccagtattattcatcatataaacagtcaagggattggagggcttcctttgaggaaactgacaagctgtctcaagtttattgggaaatcgaaaaggacttagactaatcacaacaattctgagaaagaagaccagggctgggggaatcacactacttgatttcaaaaagctataaatttactaggacagtgtggtattggtgtaaagacagagatacagattagtgaaacagaagacagtccaggaattgatcatgtatgtaagttaattcatttcaacaaatgtgtcaaggtaatttaatagggaaaggaaggacagtcttttcaataaatggtgcttgaaaaatatgcaaaatgaaacaaaacaaaattaaaggaacctagacttttaccttacactacatataaaacttaactcaaagcagatcacatacctaaatacatgggctaaaactataaaacttctcaaagcaaacaggagaaaatcttcatgaccttaaattagacaaggatttcctagacagaatgcaaaaagcatgaaccataaaattaaaaactggtaaaatggatttcatcaaaatttaaaacttttattcttcaaaagataccacaaagaaaatgaagagaagccacaaactgggagataatatttgggaaacacatgtgataaaaggcttgttgccagaatatacaaagaactcttatatttcaatagtaggacaaacaacccaataagaaaacagggtaagtgatttgaatagacacttcatcacaaaagatatgtgaatggccaacaagtatatgaaaagatgtacactatcattagttattagggaaatctaagtaaaaacagccacgatgagacaccactatatacccactagagtggctacacattttaagaaagactagcaaagatacagaataactagaactatcagacaaccctggtgagaaggcaaaacggtacagccagtttgccagtttctcacggcgtcaaacacagattactctatgacccagcaattccattcctgggcggggtttcacccacgagaaaggaatgcatgcatccacatggacttgtacatgaatgtccccagccactttattcttaatagccctaaactggaaacaacccaatgtccaccaactggtgaatggatgaagaaatcgtggtatattcacaaaatggaacactactgagcgatgacaaggaataaaccagggacacacccaacaacgtggatggatctaaaaagcattctgctgtgtgaaagaaactagacataaagcactacatactatatgattccatgtacttgacatgccagacgttactgaaaactctagggacagaaacaggtcagtggtttcaggggcaggggcaggaggagggaactgacaacacaaaggcaaaagaaacctttctggagtaagggaaacattcttcctctagagcatggtgctcactacactacgtacacatttatctaaacgcactgaactgtacactgaaaaaggtgaattttattgtatgccaacatttcaaaaacaatcaagggagagatcttaggaactcctagataaatgccaattttaaaaatataactcaacatctgttttagacagatgagcatggcccctgtgctaggatgacattcggatctgtgaagcattctataacataataataattcaattctgtgtatttactataaacatattaagttaaatatgcttccctattaaagtgaaagccgttagatttacactcttctgcttatggtgccaggcagcttgcccatccttttacttacgactttagggcccttctcacccttcccaaagtgttactttttccagtgtattaatatttaccttatattaaaaaaatgagtagtcagtttgggatgctacctactaaagaagttcctcagctatattttattgtatgcaaattacacctcaatagttgattttaaaaaaagaaaagaggaatcactttctaaaatgaataatccattgtatttttgctcaatattatgagcattcattaagaactcaccccattttcctattaaaaaaaacccaaaccaagctagcaaacaaggtgaaagggaatgtgtgtggggagtgtgggggaagagccctgggaatacactgacttcctgcttgaggaggaacaaactgtgatcagcttgcaggattaagttctatctcaggtgtgtgtcaaggagctcctttagcactcctggttctctttccaagtgtcctaactctgccccaccaaaatgtacctattctatttcacgttatctgacagcacggctttgcactaagaaatacttgacgagcttgatatactcaggcactatgtcgtcatcacaacagaggtgcattccatgaagggccagctcccagtgccactaaaccacggagtgttcaagagggagttggagtaagaagcaaaggcattttgtgacaaacaggctcttgctacatcttacaaagtcatgaacaaaaaaaccactgatgctacataagttatcaaaacaaatggcaaaaacaatattactctggacatgagtctaacacacgtgacagtgaaagtcgacaatgtaataaaagatatgaatttaggatttctttagaagttaggatggtgttagtcaccaaacctgcaatgccctctagcctagatactgattttatgccatcaaatttactgaggtaatgatttaaattcccctggagaccacaaggcaaatccatcattatgaggctgcttgactatcagtggtgagcatttagtatttttcttctatagagaccttgttaattaagagtcgcataataaaactgacaatttgtttagttagttttgttttatggtgtggagagaaagttttgtttggatttttgttttaataggagaaaaattttcccttctttgagataggctaaacaaataagcactctacacaaataatataattattggcatgaagagatgctgacctaatgctccccaaacttaagatgaacactgaggctgtgctttttcaacatctgaagaacaatgtggtctgtgcacttccacacatagcacagaggtgctatgggaacatagagaaaggaggagagaaggcttcacagaaacagtgccagccgagcctaccaatcttagtgtttaccacatacattagctgcttcaagctaaatggtatttcaaagataggtgctgtgcttaagttcacttgaaaaaaacaaacaaaaaaaagcaaaacaaaaacaaaaacactacaaagagtaggagtccttggcacactgcaatctaatttcaacttctaagttgtaacatctactatgttgaagagatacaacattctgggttaatagctattcgagatagcaactgtaggcacccttctctcttctgccagtaggctcttacttattattgcctttgcattgtcagaatgcaatagttgaatatacaaaattctgatagctcatattttgttgacaagagaaagatcttttttgctctgtaattataaaacattttcatctttagatttgtaagcatcaattagaatggtcaacccaatgacttctctcattttatattatctatttccttctaacaattttcacatacacacctgctttctgcatttgtccacttatgaaacttatccaggtacatattggtacagaaacatcatacaagattaaagaatactgttattttagcaaagagatgaaataacagtattctttaatcttattgcaaaatactaaggaaaatcttcctacagaatgaccacctggatgctaatgtcatgtttcttttttgcccttagaaatatatataattcttaagtttgagaaaattctaggctatcacctggagactcaatctgagactctctttatataattgatttcatcatcatctttacagtctaccatgctatctgtctctttgtattcatcttccggttcatccaatgtttgtgaaatgtttttctgtcaatttccttctcactgacataatgactagaaattgaaaacttctgatttttcaactatgttcactaaaagctaaaaataacctacaaagatggtttctctagttttctttcatacctacttgaaagacaatgcaatatttggggtgatataataaataaattaaaagatgaagcaatagttattactgtagcatccttctaggcaatcccattattcttattattttattcttttttttagcatagttgagaataaatgagttaataatgaatcaatttctaagatgacaaaacagcaaactatttcaagacacagaaacaaataagatcactaatactccataatgtatcttagatttacaaaatgcttcaatggacccatatgtaattacaagagagaatgaacttcattctattttaaaaataagtatattttgtctttgttttttggaagacccctaagaaagatttaagttaaaaagctatcaatcctatgaatagttagaactgttcaaaaaagaaactgaaattgggtcctgatgttatactgatggttaaaattctccacaaataattttaaacagctgtattatctatacactacctcattgagttaataaaaatattgctattttaagagacagtagtcaaaaggcaatgttattaccacagagctgctaaggacacacggccaacgtgactgcctgggcaaatgcgttctcaaacttctcattttaattctgcggaaaggttcatcaaaatcatatggtatcacctagttcttattttaagaaaacatttcactaaaaaaaaattctttatatccagtaatataaacttttagctttcaccaacatgtatgtttaacttctttattaagtatatatatatcaacatgcggtttaagctttcaactccgaatactatttcctttttttttctttaccacctcaaataaattagaagtttgaaattcatcaaacaaaactaattctttatttgggcaatatgataacattaatacacagataactttgaattctagcaactgtaaaatctaaacttaaatgttatttaccgtatatttagtgaatttatttttccctaccttcacgggacattaaaataggaaaggaagttaggttcaaaggagaaatggggctttgtagtcatcgctgccacctgaagccacctgcctctagccatggtcaacgccactgtgttcttttgacatcattgttgatggtaactcctttggcccatgcagctccttcgagctgtttgccgacaaagttccaaaaacagtggaaaactttcgtgcactgagcactggaggaaaaggatttggttataagggttcctgctttcacagaattattccagggtttattttatctgccagagtgctgacttcacacaccataataatgccagtccatctaccaggagaaatttgatgatgagaacttcatcctgaagcacacaggtcctggcatcttgtccatggcaaatgctggcccgacacaaatggttcccagtttttcacctgtgtggccaagactgagtggctggatggcaagcacaaggtctttggcaaagtgagaagagggagtgaatatcatggaagccatggagtgctctgggtccgggaatggtgagactggcaagaagatcaccactgccaactgcggacaactctaatcaatctgcttgtgtttgatcttaaccaccaaatcattctttctgtagctcaggagagcatccctccatcccacttgctcacaatatcctgtaatctttgtggtctcactgcagttctttggtttccttattcccctcgacatcaagctggattgtagttaagtttaggattataaaataaaaactcagtaacaaaaacaaacaaaggagaaatgggagaaaattaagatttggggcctctcctctccggtccgtgcctccaagatgacaaagaaaagaaggaacaaaggtcgtgctgaaaagggccgcggccacgtgcaggctattcgctgcactaactgtgcccgatgcatgcccaaggacaaggccattaagaaattcgtcattcgaaacacagtggaggccgcagcagtcaggggcattctgaagcaagtgtcttcgatgcctatgtgcttcccaagctgtgtgtgaagctacattaccgtgtgagttgtgcaattcacagcaaagtagtcaggaatcgatctcgtgaagcccgcaaggaccgaacacccccaccccgatttagacctgcgggtgctgccccatgtctcccaccaaagcccatgtaaggagctgagttcttaaagactgaagacagactattctctggagaaaaataaaatggaaattgtacttaaaaaaaaaaaaaaaagatttggggcctctgaacaggtgagctgtagagaaatgttccaaaataattcagacatgtggtcacttacttagataaataagcaaagtcaccaacatgcaacactctattcctcatcagttccctagcttggtgtccttttcacacctagggtccatagtggcactagccatgatagtgagtgccagtgaaatatctttcggctagatgcaaagggccaagcaaagagcagtgaaagaagagatgcatggagaacaatgatgaaggagacagggctgcaggggcctgtggtgtggaaggaggcaaaagagaacggtatttctgaaaatatatttggtaaccaataaatctcagttataagccaaagcactaacatgtattctattttaaaaacactttaacaaaacaaaaaccttatgaagttgaaaattatcaactttctagctaaatgacactcatactcagatattttacaagacatagccaagcactttgacaacctgacaaagtgaaatttcagaagcaaaaatgaaaaactttactgaatatccccaagtgatctaggacttagattattccccttcatgttggatacgctggcaaatcaggtaagatgcaggccatgggacctgacgtcacttgagtgttggccacttggccagataagcaaaggtgacttttctttcttccttggcggcaggccgaggggagagaatatctgttaaaagttaaaaaagctttctcctcacatctataataaatactttcagaattaacatttttattgaaacacacatctagactaaattggaaaatacgagttttacttttaagtgggaacgctatctttaaacattatgtgaagaaatctgtgccgaaaatgcccactccataattgatttgcataaaggtcagattatggtacttagaatattcaatcggaacttcaccagtaaaaacaaaagcatggaaaacccccaaaacgtgacaagtaccttgtgtattaattacagctacacattttgataacgcttattgtataccaatccagaaacaagtgaaattacacgtgtactgtgagagctctcaacagcaaagacaactagaattctctcatatataatcaaatataacttgttaaggatttcactcaaaatgtgcaatagggaaacccggatatttgatattttcataccctgaagaaaataaaatgaaaattatcttaattagtttcaaaaattttgtttgttctgaattgacatcgatttctagaatcttttctggggtgattataatgtatctatagtaactaaaactagattagttattagttagcaacttaatttaggggcaatgcaggtttgtttcatattctgaacatattttcccccttcttaatttggcatctaaagttattacatgatctgcagtatgcattaaaacacatcagcacagatagggtgctatgcatgtgtgttagctatttgccctaaatgagaaaatccattctaggagtaatgagctagcacttaatccaaaggccagatggccaccttaaatgctttagctatcttaatctccaaaccaaaccagaagctttgttgttagtaaaatgagttttcacatgcactaagtggcctcattacttagtataatggatattagaaatcactagggtaacatgagtggcattaagccatggactgattagaaagagatatatattaacttcaaatagagccttaaaaaaagataaatacataaataaaaacaaagaaagatatatatagaccctccccaatccggggtcaagggaacaagtgttgagactccagcaagtccaggaggctgtattgttgggggtgctcctagagcttgatactaaatggctgtgtgcagccagtgatctggaagatgctggttgcctggtgcagaccatattctgtcactgatactgtcacatttgcctcagtaaatctttcaggtaaacgtttggttagagaaattaaacagagctgggctgcatgcaacttacaaaactgttttcagcaactgccttttgataaatagatatgagggtgcagaatccggacgtgctttcattataacctggtcgccaaactgtaaggaggatgcctagagcccttacctagctttaactgctggaggatacttatctaccaagaggtacataatagttggaaattgccagcctggcttaagtcaacttggaaaaaaaaaaaaaaaagagagagagaaagaaaataaaaggaaagaaaagaaggatttgtggaaatagagaaagtgattctaactaaaactctgtgagggaagatgtacctgctgatccaaacaatcattttgaaattgaagtccctgtttttaaagtttcattatgagagattctttttacataaatctcctccatctggaacgcattttacttctccataaacagagaactggactaactgtgaacgattattttcttaagggtaatgctctcctaaataaagaatccctttaatataaaccatatgctagtatctttgaaagaaaagatattcttcaggaaattagtcgtctatatcagatcaaagaaatggaaccaaatggattctaaagcttatggagtttatagcctcaaatattttcactgtaagcatgtagcttataaatatgactgcatgaaatttcactgtatacacaactcattttttaacatcgtactactcttggtatgacattgatctcaacccaaggcctggcctgcccacggagcaactgcctccctcatgttctctacccttgcttctaaaatgggggcatgcatattctcagaggatctagcatatgcactaccttccccgagctcaacaacatcatgacatgccgttgaaaacatattaaagttaacaccaatatgaaggtgtgctctacagggctagggaaccttagttttgaccactggtatattcccagggcctggaagagtgtatggcactttgtagtgtctgccacattttcagtaaatgaattccataaaatccataaatatacctgtggggcactatgctaggaaccaaagatacaaagtccctactgacaaagatcttagacattctactaggaaagataataaatacacaaagtaattagttacagcttgtgataggtgccatgagggaaataaacaggatactgtgatagagaataatagaagaaatatcctcagatatggttttagactaactagctagttaggagaagaaatgtggacagatctgaaacaccttctagatgtttaaccaacaggattcactgttggcctggacgtgggccatgagaaaaaggctgattcctaggtattttgtctttctaggttttgctattgcttttattttaagtttaaccaactgggtgatttcataataccatctattgatgtaagacataaaggaacaaattttgaaaggaaaggaaaaactttcatttggaatatgttaaacttcaagaatctattgacatccatttggagatatcaattaagctgcacagtggctggcaaataataggtgcttaataattaaaagaactaaataacaaatcaaacatcaaaattacacagaattgaatttaaaaatgagtctacaacagtttctttcaaaccccaagaaccaacaccaatagataaatattaaaggggaattttaactgaacattatttaatcaatggacctaattatttttaatggagctactgagatcaactacttgttttagtactgtgtaggtaacaccttatgataacagtagatagcaataaactattactaaaaaaaatacgtatcaataaaagttgactttctaagaattaaagcccaaagtaaacaatttaaagatatctctgtttcttggtcgaattgaaagctacgtctaagaacaatgccctaataaaaaatcttttttctactaaaaacaaatcagcttttactatattagaatgcacttattatatagtagtgcaggcactttggaaggtggcacttcagctgaaatagcatttgttgaacatttggattcaatggctaattcctgcttctttcctgtgtgctgcttccaggtggctagaaaacaatctaattcttcctaccagcagaatgtaaaataggtttctatcagacttgattgtcaacctttggaataggatgtatacataacaagcattaaatagactcatgtattactttgcaaataaatttcagaaaataattaccttaatttagactataatttgaaggaacgatctagagcagggtttctcgatcttagcataactggtattttgggctcaataattctaagcggtggggactgtgccatgcattggatggtatttagcagcatccttggcctctaccaactagatgccagtggcacaccactacccaatctcccagttaaacaaagaaagatgtctccagacaccgccaacgtcccttggggaacctccaattaagaaccactgacctagagtcactccagttacaggttaaaaccctacatacatcaatgatggaaatcactgtaaggattcatagtagccatgatagccaagaccacctcaatgatccccacctctggtattcacagttccctcccacacagtatcagggttggtttgtataaccaatagaagacaatagaagaaggcatgtgatttccaaggcagagtgtgtaacttctgtctttctcttggatcacttgctctgggagaagctggctgccatgtcatggcaacattcaaggagccctatggagaggctgcctccaaagccaggaactgaggcctccagccaagagccatgtaggatagggacctcccaccaagagctacctgaggaagatttgaaggagatcctcccacctcagtcaggccttcagatgactacagctgtagccaacatctcagtgacgacctcctaagagaccctgggccagagtcacccagctaagctgctactgactttctgacacacagaaaccatgagataatcgatgcctgaagccaccaggttttaggatcatttgttacgtagcaactgataactaatatagaattatatctgtccaaacactaaaataatgagttgaaacacaccctggcagggggataaatccttacacttcgtaacagaaccactacattctttacccaaggacacaaatgacggcttagtagcaatttatcttttccaggaaaaagcggggccactgagcaccaaaactgtctctcttgaatttagggtatggtttgagggctgggggtgggggaaacagaatagattagtaacttgatttctgtggtaagataaacaattttccacaaagaagtccttgaagatcttgatggagattcacataccaaagctggcagctcactgttccttctttcctgtgatatagccactaaacacagggcatttcagtaggaaaatttcagatttagttgtggctcaggctcaatggggatgatccaggagagtgacggaaagtctgaaggaatgcagtttcctcagatcgtttctaaacccacgagtcaagtcacaggcatgcctcctactgacacaggcacatttgttaacccactttgcacataaaaagctaaattaattactaaatgaacttggattaagtgaatcttcaaattttatcttcctgggaataaacaatattccaagaaaatacatccctatttcttacataacttggaaagcgtcttgcactgaaactatctctgaaggtgctatgggctgaaatgcgtccctgcacaaattcctgtgttgaagtcctaacccccaggacctcatgatggaactgtaattaggaagagggtctttaaagaagtcattacattaaaaaagggtcattagggtgcaccctacttcaatataattggtgtcctcataagaagagattaggacacagacacacacagagggaaggccacgtgaagacatagggagaatacaaccatctataagccaaagaaagagtgcacagtgaatcagcaagagaactaacataaccaactccatttttgtttaaggggcctttacccattcctgcacatggacaaggataattttagagcactgagataatatgcaaaaacagcaatcaggtagtttttaaaactaactctgagattaaaggagaagtgtgtgaacaactatgtttcgttaaagattgatgagagcactgtgacttgactaaggacaaggatattcccaacctccttggacccttgccggcgcccagatgtctgtggtcgtcagttacctcttcatcccaaccctctccccttccccctgccttaacataaaaacagcctaaaatgtgttctgacttcagagggtcctctgggacgctagtccaccatcatcttcgtttgctggctctccagataaacctgcttttcctcccaccaactctcgtctctcgtgggtggctttcaagtggcacgcagccgaacttgggttcagttatgagaggcctcagaagaaaccaatcctgccaacaccttgcttcagacatctagcctccagaattgtggaaaagtacatttctattgtttatgctgctcccagtctgtggtacttttatatcgcagccctagtgaactaatccagagggctttatggttgcccttgtgtttgctgggtcctctgtgatcctgaatctggtcgcttccactaatcatagcaaccacaccatcggtaaattaatgtgcagaccatgatgttatctcaattttaaaaagcgtgtcacgacgacactagatcccccaaattatccatcaatgaactgctagaactgaggtctcttactctggcgttcttgacttttaccaatacttcagagcagggagaaaaaaaagggaagaattaatttgaacaacttaagtggaaataattgaacaatgaagtccttcttcaatctaacagtggaaggggtttctgaaacttgatgaccataatccagggcaaaagacttactggaggaatgtccgttgtgttgaatatgggtttagagatgatttgctgtgacagtgttgaaggtgagcagctggggtggaaaggggcagtgtctctgacgtaacagagacctggccatcacttaggataacattctcaggtgaacaggtacagctagtcaaactgaggaggaaagtaaagctttcaagttgaatagctaaggagaatttttaggctgggtgtggtggctcattcctgtaatcccagtactttgggaggctgaggcttccagcgatcctcttgcctcagcctcccaaagtactggacaacatagtgagaccctagtctctaaaaaaaaaaaagttactcttttaaattagcctggtgaagtaacgtgagcctgtagtcccggctccttgggagactgaggaaggaggatgccttgagaccaggagttggtggctgcagtgagctatgactgtgccactgcactccaggctgggtgacagagcaagaccctgtctcaaaaaaaaaaaaaaattaaagagaagtcatagtagtgacaaattattccaaagtccaaatcccacagaaaatagcaaggtaggaaaaggtcagtttaccacatctaatgcgttgaatgtttactatgcatagtgccgggctaagtgctcagcgtgcacaccatttattctctactccgattccactgacaggtgttattatcatgcccaatcaaagataaataagctcagagaggttaaattacatatccataaaataagacagagttatacatttctgtatgataaaatgatgaaagttacttacacattaccttttttcttttcaaatgtgactactagaaaatttaaaattacatgtgagcttgtattatgtctacagaactacatctattagcttcttaaaatctaggaagaaaagtaattcatttgcttaatcacagtaaacatttaactagaaatctaaggaattaaaagcttctggtgctttgaaacttacaaaacgagatgagttatcatttttcacagtcttcgcatttccaaatgattccagaattggatttgcttgcaaaagctgccgttcaagttccccctaaaagacattacacacacacaaataaaagcagatgtacgttaatctaatgtctttactcaagtcatcaggggaaaaatttctaaaaaagaaactgcatcttttcctcagttctttcattctgtctgccatccagcaacttttgttggcttcttaatcctggttatgataatggactccactaaaggaaaaaattagcatctataaagtggtcacaaggagaaaaaaatgtcacgctgaacagagaagatcaacttaagcatggggcacgtaaatcaggcagagaattttgaaaataaaacagactggctttcatgaaatgaaatttagcacgacacttcaattaagaacatattaatacttgtttattttaactctgccttatttgaaaactttaaggcagttaatttaacagttaccactgtattgatgtagcactttccagttttccaaggagtttcatatactatctctatcatatagacagggcaatgtcttcacctccactttcagaggatggtaaagacgttgatgctgctaacttgctcagatttaaaaggctaagtagagaggattcggtaaaatgtctgctttagttggtgtctttacttatatgtaaattaggctataaaacagattttacaaacaaaaggtggaaatatattaatacgtactttaatcatgaaacacaatagaaagctgtatgagaaagcatgatgccatttctggccatgaaaagcaccagaagtgatgctgtgtttctggaatgtaatttcagaattatattttatgacttaaataaacctgctttttccaaacataaatcttacccctatattttaaaatacccacagtattttagacctaaagaaaaactaaataaaagctgctaggaaatgcgatactctaagcaaaaaagatgaatataaagaacctcacatgaggcttttaaattagtggcatttggtatgtgatgcactccatcaccatcaaattcaaaaaaaagaacaaatatatgtcatccgtacagttctgtcacgccgccctggtgtggactgtcactcagctgaaagggtggggaagtgttcctcaggcacattacacaggaaggggacctgctctgcctacatccattacagcatgatctggactatccgcatgttcataggtcttaactacaatctacaaccgtgttcaactgaagccagtcaggaaccagtcttgtcaagaacctcaagctacgtggatgtcattacatggcatcggtttattttcttggcattagacagtttcctccctgtacaacaaatcttctgttttcctcacttcaaaacccttaccagactatttttcctgtaaagtttttgtttttttttttttgagacggagactcactctgtcgcccaggctggagtgcagtggcgcgatctcggctcactgcaaactccgtctcctgggttcatgccattctcctgcctcagcctcccgagtagctgggactacaggcacccgccaccatgcccggctaattttttgtatttttagtagagacggggtttcaccatgttagccaggatggtctcgtgctgtaaatttttctaaaccattacatgctgccaaactgtcttaagcatggtatcctgaacaactttgatgactgagagccattgttaaaaatgccagtcaggggccaggcgcggtggcttatgcctgtaatcccaaaactttgcgaggccaaggcaggcggatcatgaagtcaggagatcgagaccatcctggctaacacagtgaaacctgtctctactaaaaatacagaaaaattagccgggtgtggtggcgggtgcctgaggcaggagaatcgcttgaaccgaggaggcagaggttgcaatgagcagagatcgcaccactgcactccagcctgggagaaagagcgagagactcatctccaaaaaataaaaaataaaaattaaaaatgtcagtcattattcggtgatagactgccttcctccacccccccggggtcagcagtcagttccatcagcattcctatgaccaatatcttgcaaagcccttggtatactcactttgcattaactgtttgggtctctaaaagcctttttttttttaaacctaattcaatctatgtgatgagaatgtggaaacttggaaaaacactggcattctagtaagtgggacattaccttaatactaaatatctactgctagactttggattccttaaaatcacacaccatcctaccaaatcataagaaaaagactttgatagtccatctttaaagagttttcctaacttggaggtaaaaccagtaatgcatatcttactttaatattacttagatatggctaaaaggattatttgagtcaaattttctattggttcttttcttttcctctctgtgtgtgtgtgtgtgtgtgtgtgtgtgtgagtgagagagagagagagagagagagagagatccactgattctattcttcttgtgttggcttcaagtaacctggttgtatcccctgtgcctaactcggtcagtatcaggtcaaaatgatgcttggcaaatgctttgctgaatgaatgtataatcagaggttccacgggtgtccaactctttaaatgtgaggacattttttgcttatctgtgatggtggatatcatgaaaattatgcacaaacctttttttcttaaatagctcatcagctatcgttagtgtattttatgcatagctcaggacaatttttcttcttccagtgtggcccagggaagccaaaaggttggaacccagaattctagaactatttggggaggggatggtggtgagccaaaggcagcaagaagatttatgggtcctcagagtcaccatggtaatggtggactcaggcactcctccgtccctgttgctggtcccactacattgatagtgtcatggtatcactcctactaatggatttgtggacattggtgagactgagtaacgatctcaaaaactccccaaatgaatccccaaaaacctggtacaaagccaattatcataacatatagaaattaacatgagataatttctgtgttgaacaatttcataattagataaatggtgctaacagatctcaaccaaattatgaaggcatttgtaaaccatcagggggcagtgactatttacttttcctctagaattggatgggcaatgtcccttgtttctattctataatgttattttggaatgtagaaaacaagcagccttagctattgaaatgatttttaaagttctaaatatttagagttatatactgctttcaaagtttaccagtcatagtgaaaattacactcctgggtttattacatagtatataatatacacttgctatatgatatagcatgagttcgaaatggttaaaaatatatacctctttcaaaagtccagttcagcccgcaaggggactcaggctgagatccggctgtaccttgcaggcctggcagggcagagctgcaggaaggttaaaagcaggcagcagcaaccaaccacatgttgaaaaccagactctaatctcaactggcaggctctctatcacctttctgtcttggttcagcacagtttaaaccaggttggagaaagatacaaagtcatcctgaagatgactggaaacacagggagacaagtgggctggcttgaaggtatcatttgtaggggacggtcaagtttaagaacttaatcgattattttcaaatctgctctgaaattgcactatgttgaggctttgtgaactctgtgctagactttgagggtctctaagagcaacctctcttgaggaaagagggcacacagaagctgtacttgcagtcggctggtggatactaaggggatatagccaaataagacctttaattttgttataaaaagtacaccaaaagttcatagataaatgtttatttcaagttaagtattgtcactttaattttgaaaactgatttgcttatatttgttcatattttgaaaatgaagatgaaatttaaaaggtaaacataaaagactgaccacaccgctcactaggatggctttaataaaaacacagacaatgccaagtgccaatgaggatatggagaaactggaactctcacatgttcctggtggcaatgtcaaatggtgcagtctctttaaaaatgtttaacagaattaccgtatgacccagcaattttacctctaggtagctacctaagaaaaatgaaaacatatgttctcaccataacttgtacatgagtgttcacagcagcattaattacaatggccaaaaagtagaaaaaaatccatatccattcactgatgaatggataaacagaacgtgacacatatttaatattatggaatattatttggccataaaaaggaatgaagtacttatatgtgctagaatctggatgaaccttgaatatattatgctaaaagaaagaaccgtcagggaggaccacatattatatgattccattcacacgaaatgtctagaatacgcaaatacatagagacagaaagtagattagtgcttgccaggggctgaggggaaatggcaggtgactgctaatgggtatggagtttcttttggggtgaggaaaatgttctaaaattgattatgataataattgcataaagtgaatatactaaaaacactaaattgtacacttccaatgggtacattgaatggtatgtgaattatatctcatttaaattgtttcaaaaaaagaatgagtagataaacaagcaaatatataaaggactgacaaaatcaggagcctagaaatgccctcccctttgggtttacaattcatactaccgtttagtgataaaatgctggatgtacactcatggttcctcgggattcaacttttgcttataaagttcaatgtaaaatcacaaaccagtggtatcaaatcaaccaaaagaaactgtaaccttggaaagtacagacttttcacactgtaactataactttaaggcaatcattcaagttgggtgaagaagtcgcagacagggacacccagcagggggagaagtaacttcttgaatggtacccttccacggtgtgaccattccgtacggtgctgttaagtatttcacgttcctcagttgtgttggggaagaaaaattgagaacgagtattcttctaatatttctaaaaacatcagcatagctactgcttaactacgattaaaatcaacttgggaaaagcagcactgaagattgtgtgcacagtggacacatgcagtacgacatgcaaatcggcaatgaccgggaagcatggcccaaagaagctgctgccttctttgggagaacctgcttcccagggattgatttgactcaaagtaaaatctaggtgggggtaggcatgctactcacatacaacagggatccactctgtagtttaaaatgacatcgaaacaaaatgttaacaacaatgatttatgtgttccacagggaatttggaaaacctaaatctgtgtattaattgcttaacattatttcaatagcgacacaagtacaaattaaaaggacatttagcaagtacctctaaagcataaagaaaaactggtttctggtccagattttccttctttaattggcaaagaagcttttaaataccctacaggataatgactatttcatttaccctcttcatttgtatcactggtctattctgcagctaaaggagcaaaaggacatcataggccttcataggtacagtacagcttgggtggctggcaatctcttaagaatcttaagtaaggtatcttaaaatctcagtgtctatgacaattccttagatatttatgattatttctttatattaacagatcatttccataactcgatattattgtttcttgctttatatcagctttatatcattatgtttgtggaagaccaaccaaaaccattcccatgctagggaaaggattaaatccaagtatagatgtcctactctatccaaggtatctggctcaggtctgccctccttctcctcccaggtagtgagaaatggaggtcatgctatgattcttgcttttttcactgctatggtctgtggagctaaaaggcaggcatctgataactaggaagaataacagtcttccactacttgcccagcattaagaaaattgtaattgattttattttacttatttatagagatgaggtcttgctccgttgcccaggctggagcacagttgtgtgatcatagctcactgcagcctcaaatacctgggctcaggccttctgtctcagcctcccaaacagctgggactataggtgcataccactgtgcccagctctaatttattttatatattaaatataattgggcctttggtttaaaacacatacaggcataaactatgccatgccataaaactttaacagatcagaaatttgttagctctaaaggtataatttttaaaggggcagccccaaattcaaaatgtagtgtagggcacaaagctaggtttccatgtgtctgataagtattaaaataattccacctagtaaatgacatatgaaaccataatttataggcttcataaacatgcagttcaatgtcatgataaaagggcaaataaatattaaaatttattgagaaaacaaatttaaagcaaaacggcatgcgcttctcaagaaagaataaggctctaagcaataaattttcaaaattaaaattttttaatgacagatttcacttagaactagtggcatttgattctagcagagactcaatctacagacagaaattagtgcaaacactcaagactaagaagcataaagaagagcacttgcctggtgtttcactggtttaggcgattcctgctgttcattacaaacagacaaatgcaaatgttagcaagtttgagtctttgcctagcagtaagccatttccaaagcaccaagccaatgtgcagttgagaactgtggaagctgggttggctggcgttctctcaggctgtattaactaccacttctgcatgtctaaaaattaaggagaactgacatttctattcttgccctttttctgtcatcacttcttcccatatctctaccctcccctcaagctgctgtgggtagtagcaagaggctactgcaagttcagaaagaactgctgaacaattctcagcaaatctttgcaagaaattaggcatcaagccacaaccataattccagtttgccctgtcagaaaacctctttaacagcaatttccttgtatcctagcctctggggtggaaaaaagcattgctgggtaggtggcggggagcaggtggagacaagggagctgtcagttatagcagtgtggagagtagactggcttccttatttttgtttctgaaattataaaagaagaagaagatttaaaaaacaacagagcagaaacttacaggaatattatggtcctttcttcctttatgtgaagaagcaacatgggcaaggtactgaataactttctttgtattttctgtcttcccagcacctgactcacccctgaaagaaagagttaatataggctgctttaacgaaagcacagcacatgcattccaaaattacaactgataaaattaaattgtattggaacaataattaataaaaataaaaagaataaatagaaaaaataactatcagcagtagttagaaaagaaaatcatccttgtaagaggtattaaataataaacccaaataattcttttttttctttgagacagagtctcactctgctgcccgggctggagtgcagtggcgcgatcttggctcactgcaacgtctgtctcccggcttcaaggaatttttgtgcctcagcctcctaagtagctgggattacatgcacacaccaccatgcccggctaattcttatatttttagtagagatggggtttcaccatgttggccaggctggtctcgaactcctggcctcaagtgatctgctcaccttggccttttaaagcactgggattacgggcctgagccactgtgcccagccaacccaaatatttcttgatagatgccagtaagaggacacaggaaaatgttcacgacactcttttttcccttgggggtgggggggttctaccagagaagtgaaatttattagaacattcatgaagaaaactcctcagtaccataaacatatctggcactgcaaacagagaatccctaaaacaattaaattaatatgatttaatctgaagcagctgaaagaactctgagatgcctgctggtattgatactcatcttcaaagccactgaaagctttctcagatccccctctcagagcaggctagtgacgattcacttcctggtgccagtgttgtgcctcataggctgggttcctgatggcaggggctatagcctcatatatttatttatttgtgttttgtttctttctttctttctttttttttttttttttgagacaaagtcttgctctgttgcccaggctggagcacagtggcatgatctcggctcattacaacctctgcctcctgggttcaaacaattctcctgcctcagcttcccaagtagctaggaccataggcacacgccaccacgcctggctaagtttttgtatttttagtagagacagggtctagccatgttggctaggctggtctcaaacccctgacctcaagtgatccacctgcccagcctgtgttttgtttctttttaatccttgtaactttttccagtgttgacacataggcagacgtaatttgttgtcaaaatgagtaaatactatgaattttgttgtgaatgaggacaaatgccaccattttaaatgattcatatttacaagcaaggctggcacatttcaaaagttttcatttctactcactactaggcttgaaattcagacaagctgctacacacacagcgagacctgaattacggcctctgctcaaacactgaagctcccctaagacgtgatcaaagcaaacctaactttacagtcaacaaaattctcaatttggattataagaaaaatttcaatatctaattaatttttctttaaaaaaaacaccccaaactcaaaaatgttattatataccttgccaacgaataatcctctaagcatttaatctaaggattgaaaatctaatttttctaacaaagctggactctttcttggaattgtacttagaattgcactatttgggccggccacaggggctcatcctgggactttgggatgccaaggccggagaatcgctttagcccaagagttcaagatcagccaaggcagcataatgagacccacatctacaaaaaaaacacaacaaatcagctgggtgtggtaactcccacctgtagtcccagctactcaggaggctgaggtgggaagatctctcgagcctaggaagttgaggctgcagtgagctgtgattgtgccactgcaccccagcctgggcaacagagcaagaccctgtctaaaaaaaaaaaaaaaattgtactatttgaagtgtccaaaacttaaatttttcggtagtttactgaaaaattactggttgcattatcttcttaactctgcacccagataaccacaaactcaaccgcagggaagactgggtgaaggaaccctagtgaccaactgtttgcctcagtaaagaaattttcttctctgggcctcagtatcccaaatctgtaaaatgcaggcattggattagatcctttctagctccaagagctgacaattctagatataacccacttaatggtttataagactatttcctatgtgaagcttattaaccacccctcatgttatcgtaacattagttcccttctgatttgccacccacaagtgtttgaatcttaggtactccaatctaccaaacttttattttaaggtttctgcccactattcatgctaaaagaggcctttctggcaaccaagattacatcaatctgtactctcatttttatatcatctgtattattaaatccatctgttgttttcttttacaagtttgatagcttcactttttacagctgaatcttcaacctgaaaaaaattttatgatttcaggtaagaatttaatctaattgtttcccctagatgattcagcccacctcccaatatcaatgactgacaaagacattcattctcaggtgatataaaatgttatcttttagacaggcatggtggcgggcgcctgtaatcccagctactcgggaggttgaggcaggagaattgcttgaacctgggaaatggaggctgcagtaagccaagatcttgccactgcactcaagcctgggcgacagagcgagacttcacctgaaaaaaaaaaagttatctttttcttattccccatacctgtggcatacttccaagccagcaccatattcagtcgttctgaaacgtgactaaccagagcacccaccatcatccttctttttgaaaagagcaaaaagaaatcaagtagacgctgaggttttttttttaggtaaacttcaaatagtttttttctgttatctcttccccatctccctgcctcccaaataaaaaacgacaggtagaattttgagttaagtggtatcaatattcatcttattttttttttttttaggagaaatgatgtcttcatccctgtgtctcccaggtataagttttgtatttttctaagttcaaaacaagcaaggatcatgtttgccttatttatccttaaaatcatagtgcctggcagagttaagtgcttgatatagactgctgagtcaatgaatgaatgtaggtcctacgtatttttaaagtttactcctaggctctttttaataatttttgttcctatcaatctcttttcatcaccattacattttctacctggctactattggcacatagataagaaaatagtttctattcattcattcaatcacttattctttcaacaaacatttgcaaatcaacttctatgtgtcaggcattcttctgagtgctagggatagtgtgtcaatagagtccatgtccttgtggggtgcaaggttagaagaacatacataaaataaataagaacagataaagattattagattataaggatataaggaatgctgcaaaagacactaaaaggaaaaagagaaggaaggacagcccctcctctagatatgaaggtcaggggaaaggctcttgaaagatgagcaagaactggcaagtgaagagctggggaatgtgttcaggaagatggagaggtacatgcaaagaccccaaagcagaaaagagcttggcatagtccagggactgatggccaggtgccaggatttgatataaataacaatcaggggagggagtggcgagagaggcagatggagcaggaaggggaggggtgccatggaccctggaggtcatggtaaagaatctgggttttattcaagtgtaatttcttaatagctatgacagtggtctctctgttctgttcttaacagtattagaaatactgagtgtttccatattaatcgtgatgttggttgttggtttcaaaaagataatttcttattacaccaagaaatgggcctcttttttagactgatgatgacttgtctcaaatatagttatgattgttactttccagcctggtttgtctctgtggtttcccagctaaccgcctcaatggacatgcttcaacgtgtccttaaagcattttttcctgcctgtcacacttaggcagccatacttcaacaattgcttatgagctgtgctacattttacatatttcgggtctaaggtaactctgctatagaaaatatggcttcaaagatagatacattcaaaaccttactgttgagctcccaagaggatagattatgggtcttatattgcccactataaaatggggataatagctcctaatacatagggttgttgaagaaaaaatacagctcaactaaagcatatagatgacattcaataaacattatccattattgtccactcatatattcatccactatacatgaggtgatttgaattactaaactttatgaatcaatagttaggacagtggttaagaacctgagctacagaatcaaaatgacctacctagattcaaatccttctgccactccctagctatggagctttaggcaagttactcagttctctgaggctcagtttatatgcctttaaaatgagacttcacaggactgagataatgcgggaaagggcctagcactgtcctcgccaaaaggctctcaataaatggtagtggtgataccaatagttatgataatgatcaatgatgatgatgatgaagatggtaatggaaatttttaaaatctgattttaatgaaggaggtggcaggatcaaaggagtataaatcttggaaaaatagaaaaaacaatgagaaatggcacatctgtcccagatggaaacagaggaggtaactaaaagcagcttgaacaaaagcagagggaagagagccaaaaagaaagctcagcagacttctctctaagaaaattaggagactcctcagaaaagtgaacaacaggccaagacctcaaagagtgagggcaaagggaatctgacctcatttccatcaacaaaatgagatgttaacggtgaagcagtcttacactttaagtggctggttatttcactgctggtctaagacaggactatggttaaggggaaaggctgcagtcccagcatcgtgctcttttggagaagaaatccttcaaagagagtggtagaagtacaaagctaacaagaacaaagcaaggaggcttctagctggaggtgtcctgcatctgttgaagcacattcggacacaaaagatcaggagtttctaaacgtgaacatgtttgcgtttcctcaataggtctacagctttggcttctcaaagggatgtgcaatccaaaacaaaaacataaaaaacaacagcctaaagaagcagtgatgcagatcattaatacgtgaccaattctgagacctttgaattccttctggaccatggggatttccccaatgagaaacccctttttcagatctttattggtaaaaatattggtattttattttgtctggatatttgtaacactgaattcagcctagcttcaaaaatcaccctctgcttgaagttcttgttttagataacctcgatttgaaaaacaccagatacatattaccccctatattatctatacctatgcaaacatataacattagtagatgacttcctacagtttccaaactctctttagagagcagcttactgggaagagcagagattttgtgatcaacataggcttggactcaagtctcccctatcgcactggcactacctcatcaggtcttggataatgtgacagtaaatggacataacagaggtattgcaaagattaacggagagaacacttccaaagacatgttcactttccttgcatatttgcctagaacattttacatttctatttacaagttgatttgatacttctttttcttccataacatagatgtcatcgaaagtgagacacacatctaataattcccaaagttttaggacttgaggacatataaaatagagtcattagaaaagcaaattgactaaatagttaactaaataatacctttttttttttaacaagaggaaaggcatacaaattcatttaacatgagcgtggggagaatcacagtctgatagcccccctaaatagttattctcatatggcaatagggttcagagaggctgacaatctgatccagaatcacatagttcatggcagagctgggagaagaaagaacaccagagttctatctgaccacacaatgttttttcaactacattacactgttgccttcgctgtttaatcaattctatcaatttagctgccttaaaacttttaacgcatgttattcctagcaggaatcaactgttctcaatcctggctggctggctatcattacttaatgtaatatttgtatataatagataagattcctttacaaaaacatcgactgtcacatcttaataggccattgtgaggcaaccattattttataatttttacattatactcaaatatactcaaaaggagaaaaccaacttgcctaaagcagttagagtcataaaacataaacagagtattctttaaaaggggggtttaagagaacagagtaatttcctcatcaagggtgactgctttgtgaattttaattctgatgagaaggaaaatcaacatgaggattacactgtagcaggatttcacctccagttctatgggggtgcaagtgtgaaagaccactctctcctgagagaggatgcatgcagcctgagtgtcttcaccacacacgagaatactaggatactcagataaacaagcattaaacaggcggcttgcaagtgggagctcacaaggcctggcctgagtttgcagaaacaaaaggttacctggggaactatgggcagataaggccagagtgtaaattaagaagtatatccttttgggggaaaagcaaattacagaataaatgactgaaaaagtgaaatgctgacctaaaggaagatgctgaggcaaaattaatatagaaagtgtatttgggccaaggttgaagccagctgcccaggacacacttcaacttgccttgggccttttttacaagcagtttttaaaggaaagagggtacaaagagtgggctgatacaaagctgtgtgacaggaattctcactggtttacagagataacattgattagtgattggatacacactgttgaaccacaggggtgagttatagtgtctagtgtatggcattttttggctacttggcatcagtctagagcacacttaacaggtggctttaagaggtaattatctagttcaaggagggagtgaaactgttgtttccgtccaatgcctctctgggcctgataatttaaaggggcttgcattcctcacataaaaaggctttctttctcaaaagcttaaggagatgctatcaaactacttaatactgattaagaaataataataaaaccatgttgcatctagttgtatttattttttatttatttacttattttgagacggagtttcgctcttattgcccaggctggagtgcaatggcgcaatctcagctcaccacaacctccgcctcccgggttcaagcaattcttctgcttcagcctctcaagtagctgagattataggcatgcaccaccatgcccggccaattttgtatttttagtagagacggggtttctctatgttggtcaggctggttgcgaactcccagcctcaggtgatccgcccaccttggcctcccaaagtgctgggattacaggcgtgagccatcatgcctggcctgtattttcttttggtcgtactacatatatatatgtgtgtgtgtgtgtatattatatatatatatgtgtgtgtgtgtacatatatgtgtgtgtatatatgtgtatatatctatatatgtgtatatatatgtgcatgtgtgtgtgtgtatatatatatatatatagctacatatggaaagtttgtgaagttgactaaacagttttttaataagagaaaaggcatacaaatttatttaacatgagcatggggagaatcacagagtgactgcccctaaatagttatcttatgcagaaaacttaattagcttggcggtggactaagtttatgaagaccccagtcacacacacttggagtactgtatttggtggatcctcaaaggcaccatggaacatatcatattttcctaaatctaagatacattgtttaactttttcatatttttcagggcacaatgtaactttataatagacatgaacatgaaaagctgttactaaatatcagtggtatctaaaaaattttaaactataatgaggctgagagaggtggaggtaggtaagtacggggggacaggagaaggaactttctggggtgatggtattattgtctacatctggataacggtttgggttatacaaggacttaggaaatgaataattaaggtttgtgcatttaattctaagtaaattttgtttcaaaagaaaaagatgaaaatactgggcttcagttaacactatatgcttaagtacttaggggacagtgtactgatgtctatctacaattgaacttgaaatgcatcaaatgaagggattaatagcccactaaagtggtatgaaaatcactttaaactgaaaacatctcagcagccacataaggaaacatcatctaaactttagcaggaccccccagtatatgcagctgccactgacccctcccagggaggttcccagattgagaaaagcatgccctttagcaccgaacagagtgaacccagctgttcatcagcatcaaatagaccaagagaaccctccatactttcccactgaagccttaaacttcacaggacccttttgtcagggagaggatatatgccttttatttctataattccatgagacactcatcactgagtacacttgtgtaaataagtcttatcttttctctgttaatctgtctattgtcagttaacttgcaggtcccctgaacccaagttgcaagaggaaaagttttcctcccaacataaacagtataagaaggactgatggatgacagacaggataaagcaagtacagtgaaatattaacagtagaatctaggtggtagacacatggctgttcactgcaaaattctttcaactgtgctttatgtctgaaaatattcataataaaatggaaaaagcaatttaaaaaagaatggaagaaaacaaacatggtacttgatgactgcccctttgtacccaagaagagataaacccaggtgctagaagacttacctcataaatccaagtctattaattggtgacaaagtacaaactaaaatggtgtcgatcatctaatcataagtgctagcgtctgtactggccactttgggtaacaaaataagtactcacgaacttttgttctgtcaaacagcaagtcattccctccctaagtgcttcctgctttcagacgttcccaaaagtcttcatcaaaccacttcatctaagagaaggtacaagtctccacctggttttgtttgtattccaacacatccacggtggatcagctaaagtaatggctccaattgtttcatgcctcactttatgatgtttcccacctgactcatgccatgccttgccatgtcttgcttgggaatgggacagcagaatgtgacacaagcagaaacttgaacaatgcttacacactggagcttgccctcttgctgctgttgaacgctgctaccacgttaaaagccagggatagactgccagagaaagagacaccaagtggagaagaaaccaaggcacccccaccaacagtcagccagccatcccacagttgtccgtagacgcagcagtgagcctccaataagaaagctgagcctggcccagatctgcagaactgcccagctgagcccaatccaactgctgggaaacctgtagaaccgtgctgatttgagccactaagtttcagcgtgatttgctgttcaggaaaagctaatttatataactcctcaaggctaaacaatgctagcaaaaaattcatataacaaagccgactgactaactctcatctcctcaaacctcctatcctgccactcctcccctttcttattaaataccaagtcttctacttcatagaaaagagaaaccattagattagaattttctcaattcacagctccccacccctacttacccgcattggtactcatctgcctccttggcccgtcactggagaagagtcgcgccccccactaggacctcactgtgcccagacacccaacccctgtgctctgcacctcatcaccctccttgctctctcaattctccttcctgcccaaatccaagccactcccaaaatgttatcttcctctcatcagcactgaatctcacccacactaaaaacaccaaaaacaaaaatcctattgatctcttaccaccactcaactactctccaccttcccaaactacctgaaagtagcaggttcatacttgagttttctagaaattgtattttatttttgacattttcacctccccttcatgcctcaactgccacctggcttctctacctcttcgctatccccagtccactccagcaccctccactctctattgctgggtccagtgggcacgctgctgctcatctcatccactcaatctgaagtgctgacccctccctctgtcccgaaatgcctctctccccttgactgctgtgccaccacaccttcttgcctcctcatgcccctatgatgggtcattttagccttctttgtggttcttcctcctctgcctgacccttgagtgtaggctttcctcaggattccacactctgctttctctcaacacattcttctaaggtaatctcattcatcggcatggcttccatcaccttccatgccactgactcttcagatctgcatttctagcacagatctcactctcctgagctccaaacccacatatccaagagcccaatgacagctccacttacatgagccatagggacctcaaatgcaatgtgtcctaaaccaaactcattatcatccactccaaacctgttcttcctcccatgttcccatgtcaggagatttcagcaacaaaaccttctcttagctcctttttcttatgcatgtaaatcaccaagtcttggtaaatctgcctcctaaactgaacaccgcttaaacgcaaccactgctctctaggttcataactacttctatacctgaagtcctcaccatctcttgcctagataactgaatagcctcctaactggtcctcttgtttcaactcttcctccactccattttccacactgctgccaaagtaatctttctaatgtgcaaatctaattgtgtcctgttgtggatattgttttattctgctgtgaatgtttaacactgagcacacagtacagtaggcacttgataatcagtaaatgcttattgagtaaaaagaataaattactgaaacgtccagtaggcctacactttgacctatgaactaaagatgtaagtttcacagattaacattataaaatgtgtgaaaagcccagactgacaaccaaccattaacaccaaatttaagcaacttacataatcttagtcttaaaataactgcgaggtttacatcaaactcttaaaaattactgctctacttctcccctccccccagacaaaaatagttgctccactttccaagaaaatcaaaaacaaatctgaacattcaacatttacttacgtgcaaagaattgactggtcctcacgatctataaaacagaacaaaacaaacaaaaaaaagaaagtgaccatttgcctggttttaaaatatttgatataataaagttgcagtaatagcctataaaatattagtaactactcctctcgagccaagttaatgcctccaaccccattatacagtcctaaatctaatcaaaccccctcatatctcctattattatgccagagtctctgggggtaaataacagtaactcaggcttattccacacatcgtttgcctggatgactttatatgcctaattaaccttgattctcaaaccctgccgcatacaaattcaaccgggaagttttataaaaatgtatttcctggcactccacctcactaaatcattcaactctgggagatggggattaaaaacccttctttaaataagcgccccaggtgattatgacacctggccagatttggaaaccacggcctttcagaatggcttcaagaatacccacaaccagagaggaatcattgctaatgtcatcttaaaggaggaaaaaaagtattaaacactgagtggaaagaaagttgaaggaggataaacatctataaatatagtctcaagtcaacatgttttatacaccaaatacaacaaaagaatctaacatgattttaaagtgattaataatttaaggatccaactaaaattttcaaataaaaaggtgaaaatcaaaccactatctagcccatggacaaaattaccagtagaggatgcagaatttctaatcacttatgagtattactatccctatttcacagatgagaaaatgttcctcagggaggctaggtaatcctcccaagtgacacggctacgaaggggcaaggttgccaggatgaggacccaggcctgtctgcctctagcacctgtgtgtgttctcaacaatacgaaacaagtttgtcattgcctagaaaggaactgagctcacaagtcctggcccaagtagcttttttgctgcttgctatgctgtgctttcttttcctctggtggatgcctccggtgcctaaggaggatttcacagcagttaggcataaataacttccatgaaagagaaataagtgctccgttcactatgtcgtattcttttttacataatattattaaacaaatccattcatatactctatgtataaactgagatttacaaagaacacagtactgtcctgctcaagtctaatttcttttttctttttctttttttcagacagagtctcgctctgttgcccaggctggagtgcagtggtgtgatctcagctcactgcaacctccgtctcctcggctcaagtaatcctcccacctcagcctactgagtagctgggaccacaggcaggtgccaccatgcccggctaatttttgtatctttgtagagacagggttttgccatgttgcccaggctggtcttgaactcctaggcttaagggatccacctgcctcggcctcccacagtgttgggattacaggtgtgagccatggcacccggccctaatttcattctaatagctcataacctggtgttattcttccttctggctgccacagccaacatttatagtacatagtcaatgtctgcctcctttattcatttacttacacagagatcacactatatcctttcttccaacatactcttcctagacacagaaccactgggatatctcctgcatgtccctttggcctcgatccagcttcacctcctctaggaataccttcccaaacactctccctcaggtttctcaatgtcgcctttttttttttttttttgagatggagtcttgctctattgcccaggctggagtgcagtggcgcaatctcggctcactgcaagctccacctcccgggttcacgccattctcctgcctcagtctcctgagtagctgggactacaggcgcccgccaccacgcccggctaattttttgtgtttttagtagagacggggtttcaccgtgttagccaggatggtctcgatctcccgaccttgtgattcacccacctcggcctcccaaagtgctgggatcacaggcatgagccaccgtacctggccaatgttgccttcttttaagtgtattttagaatcagacaaacaatactgcggttgactgcccactagaatgcattgcttgagatccgagactgtcttacttctttattctcaggattaacagccttggtgagccacagctagctttaatagaggtctgctgagagaaacccagtgctaggtgccatgtgggcactggcaagataatggggcctggaatcttttctagttctagctctgccacaaactgtgtatctataaatgaggcatttattccttgctggctggttcttcacctataaaccatgattttaccacgtctttgcttattcactctcaatatgaatcttcagacccccgaattttcctggtcttagcaatttctatagaactccactataccaagttgtttatggtttttcgaaagtagtttacacattaaagaaatcaaagcacacaaaaattaacccaaatcgaattgcctcctaattcattcaaaatggcgttcttcctgcgtctgtacatgctattatcaatgtctaaaatttgagacctacactacagcctgctgcatacttcattcccccacgcttcttgctatcccaccccctgtcaaacaacaacaaaaaaccaactctcttctagccagactcatctatttttgttatttgtctgtctgatcttgtattaactttgggcctcagtacacaggggataggcttgccaacctcccagattctctccaactctgtgatcaactccccacctctgcttcactgaatcctctgtacccttcaaggatcaactgcaggactacgacagtttccaatgatctttatactctaaaaccctatacatgtaaccaaacagagccttacggtgatattaaagggggaaaaactcactttcaaaaatgcaactagccttctaaacagtagggactcatttgatagctcagtattttccaaagcaccttctaaaaatcacataaggaggtatgcaataaatccatgttgaatcaaatcattttctaaacatgagaaagtttttaaatcaatgatctgggctcttacctaaataaaaactagaaaagagcaaattaaatcaaaagtaaggagaagaaaggaaatgataaagaaatcaatgaaatggaaaacagaaaaaagaaaaaaaaatcaatgaaaccaaatgttccttctttgagaagatcaatggtattgacaaacctctagctgaagtaatcaggaaaaaggagaaaaggacacaaactgccaatatctgtaatttttaaaaagtagtatgattaagaacccatggatattgaaaagataataagaaaatattaagaatgactttatgacaaaatattcaacaactaagatgaaagggataaattatttaaaagacacaaccactaaaactcactcaagaagaaatggtaacctgcatagccttctatctattaaagaaaatgaaattgtaattaaaaatcttctcacaaagaaatcatagctctattagaaaattctccaaaacaggtagggaataaataacaccaattctatataaactctttagaaaactgaagaggaagaagcatttctcaatccattctaagagacaaaccttaccctgataatgaaatcagaaaaaaaaaaaaaaaaaaaaaaaaaagacattgcaataaaagaaaaccacatataaatatcactcataaacaaatgctcaaaaatccttaacaaaatgttggtaaatcaaatccagctatatatatatatatatatatatatatatatatatataaaagatgatgcacagaaagaacaaatggtgtctgtcctgggagtgcaaggctagttcaacatcccaaaggtgaataatctaattcatcacatcaacagacttaaagaagaaacaccctctgaccatctgaatagatgtaaaaaagcgtttgacaaaacttaatatccactgatgatttttaaaaactcagcaaactagaaatacaagggaacttcaacctgataaaggtcagtcacaaacaaccctacagttaatatcctctttaatagtgaaaaactgaatgctatccctctaaggtcagggacaagggaaggatatttgttctcaccactcctattcaacgctacaaagtaagaaaacaaaatccaaagcatagattgaaaaggaggaaatagcaatgtctctgtttgcagaggacatagacagaaaatcccaaacaatctacaatacacaaaaacaaacaaacaaacaaacaaaaaaaccctttcagactaagtttagcaaggttgcaaaaaaagtcaatgtatattttaaatatcctatttctatatattaataatgaacaatttgaaattgaaattttgaaagttccattaaaactaaaaaaattaaatgtttagttataccaaggtatatgatatacttggttataaatctgatgaagtatacgcaacatctctgtatgctgaaaactacaaaacactaatgaaagaagtcaaagaagacctatagagagacaaactgttgatggattggaagactcaatattgttgttaattcggcctcaactgatctatagattcagtgcaatccaatcaaaatgttagcaggatattttgggcaaaaagcgacaaactgatttctaaaatttatacctatggaaagacaaaggaactaaaataaagaattttttaaaagaacagtggtagaagactcacactacctgatttcaaggtttactgtaaagctactgtaactaagccagtgtgatactggcaaaaggaaagacatatagatcaaaggaacagagagtcctggaatagacctttgttgattttccacaaaggtacaaaggcaattcaatggagaaatagttgtttcaacaaatagtgctagaacaattgaatatccataagcaaaaagatgactcgcaacccatactttgcaccatatacaaaaattaaaccaaaataggtcacagactgggaggaaaaaaattgcaaatcacttatccaataaaagacttatatctagaaaggacaaagaactctcaaaattgaaaaatcagaaaactatcaaatttttaaaaatgatagtaagatttggacatttcaccaaagatatacagatgcaaaataagcacatcaaaagatgcattaggaaaatgcaacttaaaactacagtgagatactactactcatctattagaaagaatacaatttaataaagatggacaataccaagggctaacaaggatggcgaacacctggaattcatctattgctggtagaaatgcaaaatggcacagccactttagaaaatagtttggtaatttcttataaagttaaacacacatctaccatatgacccagcgatcttactcctaggtattgactcaaatgaaatgaaaacttatgctcacacaaaagcctgtatacaaatgttgacccccgttatctgtgggggattggttccacgacaaccccaacccacagcagataaaaaaatccatggatactcaagtcccttatataaaatggcagagtatctgcaaataccctacacacatcctcccctatattgaaactttaagtcctgtctagattacttataatagtataatgaaaatgctatgtaaatagttgctatagtgtattgtttagggaataatgaaaagaacaaaagtctgtctgtacatcttcagtacaggcgcaaccatccattattttccccaatccacagttggttgaatctgcaaatgtgggacccacgaatacagagggccaactgtacagtgtcttaattgccaaaaactgaaaacaatctaaatgttctttacatggtgagtgaataaaccatggaatatgcatataatggactattactcagcactaaaaaagaatgaactactggtgaatgaatctcaaatgcattatgctaaaaaaagaagccacactcaaaaggttaaagtgtggatgactataggacattctcgaaacggcagcactagtgtttattcctagcgtttatttatttttggctacagtaaaggataatgggtgattcataagaaacctaatgatttttggacattttaaaactaatcgccttatgaaatcgccatttcactctccttaatcccttcaatctgtgtgccctcaccctcttttcgttttcctcatactactcaatattgtctttatttgtatgctgtctccccagtaagaacagttcttttttttttttttttttttttttgagacagagttttgctcttgtcacccaggctgcagtgcaatggcgtgatctccgctcactgcaacctccgcctcccgggttcaagcgattctcctgcctcagcctcccaagtagctgggattacaggaattcgccaccacacccggctaattttgtatttttagtagagacagttttctccatattggtcaggctggtcttgaactcccaacctcaggtgatccgcctgccttggcctcccaaagtgctgggattacaggcatgagtcaccaagcccggcccaagaacagttgtttaacggtgtcagtgcaagggttttaccatatcttacagcttcacagggtggtgaggagggatagttcctactgtctatatctctacatcagaagattcaatacaaagatccaagacaactataaatcactattaaatgttccttttcctgacataaaataatgctctttgtccttgttttggctttgaggtctactttaggctgaagtgactttagactatgctttctttttgtatgtatttggctgaggtatctgcccagtcttgtacttttattattttgctactttgagatgtctttcttgtaaatggcatatgagtgtattaggctctcttttatttacaggggtgttaaaagtacttatgtttattgttataagtgctatatttggtgttacatattttctgactttttttttttttttttgagacagagtctcactctgttacccaagctggagtgcagtggcgcgatcttggctcactgaaatctccgcctcccaggttcaagtgattctcgtgcctcagcctcctgagcagctgggattacaggcatgagttaccacgcccagctaattcttttctattttgagtagagatggggttttcaccatgttggccaggctggtctcgactcctgacctcaggtgatccacctgcctcagcctcccaagctgggattatgggcgtaagccactgtgcctggcccattttctgactttttaaagccttccttgatgtttcttttatagaatggcttgttttccttgcttttatttctcctaatgtaggaaacttgtatccagtttcgaagtccttcaacttgctttctcaaggttcacattttgatgtgtagcaaccttattcttaaaatgcttattcttaaaagggagggggagtaggagggagggggagtaggagggagggggagtaggagggagggggagtaggtctacctgttaccctcacaagatcactcagtagtcctaacatcttttcaaggtggctgcttgccatttcactgtatggatgagccatcctctaattaattacttattgatataataattggttgtttccagtgtttctcaggaagctaccagaggttatcctctatccaaaaattttaacagcatatgagatccataaattaatacaaccaaggaaagaagcaaaaggaatttctagattacgtaagggcaaaggcaagtctaaagaaacaagcacgaactggaggaggataacaggctttgggaggtgcgtcgtcaagggggaaagaccctgagaaattacttgatgcacttgtgtctactgaaagaggatgtgtagttcaaattgatgtaggtgattgcaaaactaccctagtccccaaaatgggaaaaatactaaccacaaagaaaacaaattatataagaaaggaaatgtaatcataggataataattaaaatgttgaatgttaaaatgtaaaatgttgattgaacttctatcaggaagatatggggagggtttagatgagtataaaaactcttcttccataataggcagtctaaagatagaaagacaagaaagaaagaaaagaaaggagaagaaaagaaagaaagagaagaaagaaagaaaaagaatatcataggcttcttacttattaataattatttatatacttatatacttatttatatatgtacatatgtaagaagaaattcctaaagagggaatccagaatagttagggtatctccagttttatgtcttattctactgtgtatttctgttttttaaaactatctttatatgttgccttaattaaaaagtaaaacataatttaagcattcaaatttctttgacaaattctgatcttgatgctatatagtttactcatttttttttttttgagatggagtctcactgtcgcctgtgctagaatgcaatggtgcaatctcagctcactgcaacctctgcctcccaggttcaagggattctccttgtctcagtctcccaagtagctgggattacaggtgcccgccaccaggcccggctaattttttttttgtatttttagtagagacggggtttcactatgtgggccaggctggtctcgaactcctgacctcatgatccacccgccccagcctcccaaagtgctgagattacaggcgtgacccactgtgtccggcctactctgcattgtttaatggtctaacccatttagattacataggaagtacctagtccttaagatttggtttgtttgtttttgagacggagtctccctctgtcacccaggctggagtgcagtgggcgtgatctcagctcactgcaagctctgcctcccgggttcaggccattctcctgcctcagcctccagagtagctgggactacagtcgcatgccaccctagtccttaagatttgacagacctgaccactaaaattgtttgggccttgtgtcttgaagacataaagatagatcttcaacaatctcttctacttctcccatggacaatgttctggttaagttttccaccttattttgagtcaattttgtctttgcttatggtgttctatatactctttgtcatttctggtagttctgtcttcttgatcacacttgccaaacatttgtctagtctgtcttttcgtgggaccagctcttagttgtacttaccagttctaggagaaaatgttctttgttccaatccacttatctcttcctacattttccctcttgttttggttcatttcattgtacttttaagtaccttttttattatgaaatgacacacagaaaaaaagcaatgtacagctcaataaattagcaaaaaattgtctattatctattttgctgaatacaaactttaatttgtctataaatctttctttcctaatgaaaacgtttagagccatgaactatttcttaaaagtggcttttgccataactcacaaaatttttatatgtagcattttgtaccttttttttttttttgagacggggtcttgctctgttgcccaggctggagtgcagtggcatgatctcagttcactgcaacctccacctcccaggctcaagcaatcttcccacctcagcctcctgagtagctaggactatagaagcatgccaccacatctggctaatttttttatttttcgtagagctgggggttcaccatgttgcccaggctggtcttgaactcctgagctcaagtgatctgcccaccttggcctcccaaagtcctgagattacaggcgtgagccatggtgcccagcctgttgtagtgatttctaaagaatctgtaagttttgatttcctcttttaccaaaagccacatagatgagtgattaataacaaaacattcatactcattaaacacactcccacaaacactaacccatttggaaatctttttattgctaatatcttgtcttattgcactgtggtcagagaatgtagcctgtgatttcttctttcaggaactgagatttttattggtggcctgctatatggaatagacaccacatttgtaaatgtgctttctgcttgcatacatacatttttcaatataagcttgctaagttgtattaaatcacattctttaatattctttttttccctacttaatatgtcaaattctgagagaagcatattaaaactccctctataactgtggttcacattctccttacatttccaatagcaactgttttaaatatttgatgcaatgtcagtgatgtacatgtaagtattatctgtctctcctagatgactacatcacactatttctatcttaaaccaccaatctctcctccctcctcctcactctcagctgaaaccctgcttcattttcacaagctcctgccagcaaccatatctgcctacccatctgcaacactgttttgaaaaatctggctgtaaaaggaaggtggaaggaactaactttcttatttaaagtaacgggtaaaactttagctaatagggaaaatttattgctaatgttaggagcctataaaaagagaagcagaagatacagtcacaacccagaataatcaacaccatgagattcttaagaaggttaagaggatgtgatcagcatcagaggtgaaggactaggtaagaccagcctttgacaggagtagacacaagagataatgatctgttcatctagctggggcagtttctctgcagtgcctctgtggaatgggaaacaagccatcagccagggagtagaggggcaaggagggacccagagatctggagcctgcagaggtttgaaatagtcattatggagagtgggaggaccaaggtaggattagcaagagttgagtgtagaatcagggctcacggtcaggaaattacagtggtatttatctgttccattatgtgagcataactccagaagcatcagcaacccaagtaacagcattaaaagagacaaatatcttgattcatccagcgtgagttttaccaaacaagaataaccaatgaacaacgggacaagggaggggtttaggaaatgggtagaagatggccatgaaatctaaattatacaaggcagaaagtgaagggtgttgttaacatatagggggaaagtaaaacaagtaatgggctggggatccacatgaagtcaaagaacacatttaggagattggactctcttctcctaagaagtccaatcttcttgattggactaccaatatggaaggatgctgcattagaactactgaaacattatctgaaaagtcagttaattctaaaagatggcaaagtctagagcatcaccatagatgttggtggcataagtgagagacggaggaattcatatgaaggaccttacgatcaagggacttgactgttcattaaaaactatgaagtaacacagggcaatggcaaggcttgaggcagagaggaaacaacgtgctggggcccatcatggagtgagagaggaaccaagaagaaagctgctgaaagtaatgagtggtgatggaggtgcggcttttccaaggcagtaaaggagtaatggtttagcagacacatagacacagtgttagtaaggacactaaccctatctcccagtgcataggatttgagtgatggagcactcttcactaaatggactcataccccgtatgtgggggaaagccaagtctcggttaaagcttgaaggaaaagaaaatattcactgaagatactaaacatacagaaagtttgcacatcagagagtgggagttacctaaggcaaaaatgaaaagggagtattatggaaatgaaaacatgactggaaacacagtgaatttcattccaggattccatgaagatggtggactctcatgtcttaaattttcattgtggcctaaaaaagtggcccctgcaggtattgttacagcaagcaaaactttcctttccatctacccaggtcaaccggggttggtagcagtgttggttgcctgctgctgaatggaagctacctggggtggaactgggctggtgaggcatcaggaacaaaggaagacaagccacaaggtggtgagcctcactgtgggtactcctaggtgacctcagatgattatgtgcaaggtagaggcctcggtgttcctaaattcagttcctaacacacagtgttgcaaatgagaagcccgatgctactgactccctttccatgtcatgttgccctatccaccaaggtatgcaagatgaagcgtatctcctttcactatttccacccagcacttttatctgaacacctgagtgtgtctttagttcaggtgacctttttcaaaaatatcacttttttcatggaacccaagaatctacaaatacattccatgtttcctactccttctctcataagcaccatctgattctttttggtctccattctagtcttcaaatctactgctctagtttccaattctgtctaatctaccattccatgcttttaatgaatgtatgattttttgcagtcaagtttacgtctaagaactctgctttcattcattcattcaacaaatatttattaagcaactactatgtgccaggcacacaactgcattttgatacagtatcccctaaaatccaatttaaaaaaaattaagctagcttcctgctttttcacataaaaagcaaaaacttttgaatattttttattaatacacttaaagatgtgggatgtgtgaccaaaaagtttgtgcatgatatgaaactaggaaggatgataaatacatttcatgcaagaaacagaatcttttttttttttttttgagacggagtctcgttctttcgcccaggccggaccacagtgtcacgatctcggctcactgcaaactgcgcctcccgggttcacgccattctcccgcctcagcctcccgagtagctgggactacaggcgcgtgctgccacgcccggctaattttttgtattttctttaatacagacggggtttcaccgtgttagccaggatgatctcgatctcctgacctcgtgatccgctggcctcagcctcccaaagtgctgggattataggcgtgagccaccgtgcccggccaagaaacagaatcttaaaagctcttggcagcttggatggggaattgaatctaaaatgatagatcagtggggccacgtgctctgaattctccacacggtccttggtcaggctactgatcctcttcttaggtccagtgacacttagctatccattcacatttgtaattgaagacctagattgattggcattggtagccggtgtgagctttaccagcaatgctgcatatgctaatgtctgactagccctgcagatgccccctcaattatgttgtgtagtagatcagcaggtagccccctacttacaaaatcaaatacaaagggaaattgtttagagtgggttgttttcattttctgtatcaaacttttaaatttttatgtaatcaaaactatcatcaactaattccttttaactttcacatggaggtttattattgtggataagaatgtgtcacactgcctggttttgaatcctagcttgtatttttcactatatacactttgttggtcaagttatttatttaactttcttgtgccttggtaaaatagggatagtaattctatttactttacaagcttgtcattaactaaataagacacaaagcctttacccagtgcttgacacacagtaattttcaataaatgtttattctagcactaaaaatgatattaataatatgatatgctgataagccacatctgcctcatatcttcctcattctgtttactaaagaggagttttcaccagcaaagccacagagccaacaattcttcctcatactgtatccatacagctggtctgggaacccactaatgggatataatgtttatccctgttaactattatgttagattcaactcctcattcaacctgtcaagagatttttaaatcctgtttcttttcatcaaatgtatcattatccctcccagtttcatgccattgacaaattttacaggaatgcatcccacctcttcaagtatgctgataaaaatattaaaagggggcacacaccctttggtgcacatccggatagatctggtcaacctcagtcattaatcagtcattaatcaatatactcacattgttttcagactgttctcttaacatattttaagctcaaggattggtttaaaggtttcccttttaaaaaattagaatgatacatgtgagcctgtccccatctttctggaaactccccttctatagaatacatcaaagaccagagggtcaacaatctcaattgtgagatgttatctgtttaaatgaggaacaatatgggcttaatcagagaaagagagcgctttcttctgtttcttctcccacatatggcacagtttgctcactaatacaaacactcttctgcatctaaagatcattcttcttaacagagacagaaccaaaaacaaaaagagtggatgattcttcattctccatctctaacagcaatttttcacagtcctagccatttcttagtattccctaagaatactaagaaattgtattgaactccaaaaaaagattattaaatttaatctttctttaaaagcctaagctcatttttaaattacaaaactgtccttaccaacttatgtatgacactattctagtcttgaagcacctcctgtttgccctggaagatctggtatataataagtatccaaacaaaaactagaagtaggacgtgggtattgtactttattaattccttcacactatccttcagacctgatcaccaaaaagaacttgccatgacctgcaatttgatgaaaagtgggtgcagcacagcccgttttctgaagattgtggaacgattttataagaaccttatgctttttattaaaacttatagaatttagtaacaaaaaatacattaaaaaggagagagagggagagttattacagaagattgggttttcacgtagcaccaggaactcccatgtttaaatgaagtcttgtagagcaataatattaattgcattcaaaaccactacattccggtcttttaaaaatgtccctccataaatcactgtgtctaaagccagggttcaaatgaatgactcctcaaatttatattcattctgatccaaaggaatacaatcaaaatcaaccaacttaacacatgctttttaacttttattgtcacccttttacatgcatttaaatcacaaataatactttacaatttttctttccccagtgcagcatctacctttcctattattcttcctattggttttaaaacctaatataatgagctttggttagaccgccttgtggtgggaatcaaatgtatatgaaaactagatgctttttaacatacaaatttatgaggtattgttttagagcaacaaacatacttatcatacttacagaaaatggctgtgttgtctgttttaatcttaaaaactcaatttttctacaataaacattacttttttattaattttaaaaaaataaaatttaacttttgtagaatacattgagacattaaaaaacagtaaattacatttaagaaattctgagcatttagtattcaaatatttccaattaccttgaagcatgcatctgtaagcagattcagatatagcatagatgtgtggaggcatctcatgacgcttcttccctctgtacatttcaataatattctcagagtaaattggaagattcttgtaagggtttataactacacagaagagtccagaataagtctagaataaaaataaaatagagtattaaaaaaaaaacctctgcatttatcaatcagggtccaatcaggagacagaaaccaaagagtcatttaagcaggagatctttaccttttggataattaatctatcccccaaattaaacttagcctataatgggcaatttagtactatgaaccacaagtagttctcccacagatagcttattaagtggcactctgctggactcaatttcctcatccatgaagtagaaataatgcgagcttcctgacttcacgtggctatcataaggtacaatcaatatgttatttacttttttacattcattctctcatgagtacacaagctatgaaaagctcgttaatgcagtttcagattccatattgcaattaatctttaagaaaatagcatttgtccagtttgggtacagtatcaaagaagaatatccacaattatctaaaaagggtattaaaatactcttcttggccaggcacggtggctcacgcctgtaatcccagcactttgagaggccgaggagggtggatcacaaggtcaggagttcaagactagcctggccaagatggtgaaaccctgtctctactaaaaatacaaaaattagccgggcacagtggcaggcgcctgtaatcccagctactcaggaggctgaggtaggaaaatcgcctgaaccccagggggcagaggctgcagtaagcctagatcgcatcactgtactccagcctgggtaagaaagtgagactccatcacaaacaaacaaacaaacaaacaaacaaaagaaaaaccactcttctttttttccaactaaatatctccatggctggattttcttcatatgccttacccaaaatgacatgttataagaaaacagaatgcaaaagcagatatgagattccagctatgtttggttaatactaaagagatttgtaaaaatgtaagagttttcatctgtctaatttttttttgttttggaaaatacagggatttttttttcttaaaaatgtatttacttatgttaacttgtcatgattaactactattctttttaaatgaattaataaagatttaaaatgtattttaattactgatacagtaaatatcaataaacataagccaaataaacaaaagctctttgggatggatcttcagtaaataaaagctgctaggctagaaaatacaaacttttcctgatcaatactatcaattacacagaattgaccctatgaatgcttatgacttgcgggttttttaaatgtagacagaatgatttctgagaatattctacaaaactgattctgggcactacggaaaaacaagagcagtcagaaccgctgacagatgctctaaccctctaagggactgaaggcatctggaagggcactcagttgcattatgaaacagatcttttatttgaggtgatttgggtagaccaaaatctaaaagcaagaggacatgaaaaaaggctggagaattggtactgtatggccagcttccccagggaacactaagggggattctaactaacagccgtgttcataagagctgaaacccccagcaattgccaccagaaagctctccagagactactctgtttactaatgctaaaccaagagaatgaaagcctgccaaaaaatttcaagtgatcagaactgtctctctggctgcccgccttgtattttcctgaactcacaattgcaggctcagatgtggaacgcacttcctacttaggttagcagtttagaaggggcaaagggcccttatcctaaattcagatttgggctgtttgctgaagccttactactgagcagaccaggaggttatctgttcgttctttgcctgagactgtactaattactatagactcctcaagtcttcagactcttggccttcttgtatgcaaagtacagacctggcaaaccctggctggcccttggggttcccagaccaacaccttgcactttctcccaatcaagtctcttgtctatctagtcccgtatttctttgctgcccacaggacaaaagggcaatgaggaacaataaaaataaaggctttattaaggctgagaaaaacaaaggagaggcaacctcaatacctttttaggagtttaatttatataacgttaacaaatcgcaaccatacattgatgaatttttgtacaaccaccctcactttttcattcaaaaatgagatcacagtctataaggaagctacagattatactcttcaattttataaaaggcatgtaattagagactagaaagtaaaaaagctccaagaaaacgaaaatacacaaattcagtttagtgtcccatagcacgtatggcatggtaacagataataactgacacatttaatcagaagtaattccaacatgtgtgtctaccatgcattaggtacttacctgaggactacaataagagagaataagtctcacaaatatgagttcatcatcaaaaatataaaaggttaactaatcatcagtatcccatgcttgccaaaatggagcagtaatcaatgcttaagaaggaacattattaaagtgcttaaagagctaacttctaactacctaaaaaattagcacaagtattgagctcttgtataaactgatcactgaatagatactgcaccagttctgtcttcccccagacacatggtaggaaggcaatatgttgttaaaattattctggagaccttaaagttcaaatgaacttaactaagtatttgaatacacacagaagatactaagcttctttaagaaacatacactctgggcatgaagacaaatagacgcacactaaacaagctacaatgcaaagcaccaaaaagagaaagagaaagatgaactggtattataaataacagaaagctctggggcagaacacaacaaaccccaggcactgaaagtcatgaccaccttgtcagagactgtagaacaaggtaaaaaatgcagacccaaatggtctttgatgttctttttaaagactatggggtcaaaaggagagataaaggaattcctattaaagtagtaaaagcacaaaactcttacagtggcaggatatactcgaggcagtgcgagaagaccagcatagcaaaaatagtttgtaccatggaatgtgagcgacaagggcctaaaaaaacaaactgaacaattcggattttgtcatctatgggtgatgaggtattgaaggttcaggagagaaaagtgattggatgaaataagcatttcagacaaagtacaaatctggcagccatacggagaacacattgaaggggcaaaaggtgagaagcaggaagacacgtggagactgctcaacggtccttggcacaacagggcctagatgacagaaaaggcaacacaaaacagagaaggccgggacttcacagtgctcagaaactttcaacacagaaaagccattaaagaccgaagtcaaagaggactccaaggtctccaggccttacagaaacattattcgtggaaggaaaaacaactgatttgtgggaaaagataacaaatccctttaatgtactgacactgtggtatggtgggtgagccaagcaggatgcctcttgggcagctggaaatattggattgccagagccttgggaaaatcctgaagagctgcaaaggcctgaaaggttaagtttgcataataacactactgtatactttacctaagggagacatacaaaaatatttgcagttggaaacatttacaaattttcaagcccactatgctgctttatgcctccaggctcccacctatgctgaccactctgcctggaatgcccatcttcctctgtctatgattgggaaatttttttttttttttttttgagacggagtctcgctctgtcgccaggctggagtgcagtggcacgatctcggctcactgcaagctccgcctcccgggctgacgccattctcctgcatcagccttccgcgtagctgggactacaggcgcctgccaccacgccccgctaatttttttgtatttttagtagagacggggtttcactgtgttagccaggatggcctcgatcccctgacctcgtgatctgcccgccttggcctcccaaagtgctgggattacaggcatgagccaccgcgcccagccgattgggaaatttttcagcctggaagtgcccggcctctgtttaagaaagcagggctatgtatatgcattgtttcataggttcaaaggattagagaaacaggaagtgtaggctggtgcaaatgtcaacgcaatggagcagagatacaatagtctcctactacgaacagggattgaactgggaatatcatgtaaccctacatcccaactgtagctctcagaagaaatcagaccaccatcgagaaggaaagggaggaaggaaagaataattcacccataccacctgcaaacactgcacctagttaaaattcacatgcaaattttgaaaaaaaacctaaataataagatcatcattcagaggattcagaaataaattacctgtggaaattatctataaaataactaaaagaaaactttaggagacagatttatatctgtaacagaatatagtataacatagagtctacgtattaggacagaaatgcataagaaaaaaaataggtgaccagggccagaaaagactgtaaggaatcatctgaaaacgtaaaattaaaatccacagtggagaaaataaagggcagaatggatacctcaggaaatcaagtgataagagcagacatttattataggagagcatccttcttaaagaaaaatagaacaatggtaaaataataaaagaaaatgacgttacaaaggcaaaacttatcagtaataataatacatagagggcagaggaaggataactaacattagttgctattgcttctttgagagaaaatagcaaaaacactctgtaaaaaaaaaaaacttgagaaaactgtgtgtgtggaggaatacacattgaattaaaaggaattcgctaagctaacaaacgcagaaggaataatggcactggactcaccattttgcagctcccagtgccacagtggatctgcacaatgcccatcactattaaaatttttaggtgactggcagatgaggccactcctcatgcacaaaccaggctggcaaaacctaaaatgactcactactgatcaatctcaacatcataaagtgagagacaatgtagcattaagtgtctcctgaatctgaatccgtttaagcctctggatccaatttatggatttttctccttccagtttatagggagcaccataggattgcaaaaaaaaaaaaaaaaaaaaagggttgggggaagcggccgggcatggtagctcatgcttgtaaccccagcactttgggaagccacggtgggaagatcacttgagctcaggagttcaagactagcctgggcaatatagtgagacccctatctccagaagcaaaaaaaaataaaaaataaataaaaataaataaaaagaggggagagaaagagattaaaagtgatataacaattgctatgctttgactgtgtccccacaaaagcatgtgctggaaatttaatccccagtgcaacaatgttgggaggtgaggcctattgagaggtgcttagataatgagggctccaccttcatcaatggattaatgccaattataaaagggcttgtggctataaattctatctcttgctctctcttgagcatgctcttcttgcccttccgccttctcccatggaatgatgccgcaagaaggccccaccagatgcagccccttgaccttggacttcccagcctctagaaccataagccaaataaacttctcttgtttataaatcatacaatctgtgttattttgttatagcaacacaaaacagactaagcaaccaatctcaatatgtcaaccttgtttggatcctgaattgtacagaccaactatttatgagattatttatgagacaaaaggaaaataagaaaagtaactgaatatttgatgattagagaattgttatttctttcttagatagataatagttatgcatcccaaaacccgttgctgagaagatgctaagcagagctttcagcagcacaaaagtctaagagaacaaaaattaaaacattccagtctactcaggaagaggttggtgtggcggtggtaaataccccaagctttcagctgggaccctgatggctacaccctaagagttaagactatatgagaaacagaccagccctcacacagcgtgaagcccagttggaacagaagtcaactcctgcatggactacatgtcctagtttccctaagcctgcctgcccaaagcaaaactctagaataagcttaatgccagccagagtctcaaactatttccacaattccttgtacacaataactgggcatatgaggcaacaagttgtggctgaaatccaagataatatctggaacctctgtgtgtctatttttattgacttgtattattgccctgggttacaatatgttcaagtaattaaagacgtgactgagaattctgacagagaactggaaactattaaaggaaaaacccaaatgaaaattctaaaactgaaaaacaaaacaaaacaaaacaaaacaaaaaaagaaaaccagtaactacaattaagaattcatgtgttaaacagcaagctagatacagctgaagaaacaattagttacacggcattttaatcagaggcaaacagccagagtgatccatgggggaaaaacaaggataaaaatgtagaggaatgtgagacccagatgggacgaggtgaaacgatctggagcatgtgaagtatgtgagtccaagaaggagaaaaaagagaatgaggcagaagcagtatctgaagagataatggctaagaattttcccggaccaacaaaagccatcaagccacagagtcaaaaccactacaatctccaagctgaatgcagtagtgccccttatctgtggtttcactttctgcagtttgttgtccacaatcaactgtggtccaaaaatatttgttgaaaaactccagaaataaacagttcatacattttaaattgtgcactattctgagtagtgtgatgaaatctggcacaattccgctccatcgtgcacagaccgtgaattatcccttcgtccagcatcatcatgctgtacagctattaatcacttggtagccctctcagatctcagatcaactgtgttcaagtcacctttattttacttaagaatagccccaagcacaagagtagtgatgctggcaattctgatatgccaaagagaagccacaaagtgcttcctttaagtgatatggtaagttttcaacttaataacgataaaatcatatgctgaggctgctaggatctatgggaagaatcaatcttctatctgtgaatttgtgaactaggaaaaagaaattcatcaaatcatcacaagaagagtacaataagatattctgaaagagggagagaaaccacttacataacttttattaagtatattgttttaattgctctattttaatagttattgttgttaatctcccaccacgcctaaattgtaaattaaattttatcataggtatggccaggtgcggtggctcacacctgtaatcgcagcactttgggaggccaaggagggggcagatcacgaggtcaggagttcaaaaccagcctgaccaacacggtgaaaccccgtctctactaaaaataccaaaattagccaggcgtggtggcgcacgcctgtaatccccgctactcaagaggctgaggcagtggaattgcttgaactggcaggtggaggttgcagtgagccgagattgcaccgttgcactccagcctgggctacagagggagactctgttctgtctcaaaaaaaaaaaaaaattatcataggtatgtatgtataggaaaaaacatcatatatatatggttcagtaccatttgtggtttcaggcatccactggggatcttagaatgtatcccttgaagacaaggaggacccactatatacaaaataaaactttacctaagcccatcacagtaaaagtgttgaaatccaaagacagagaaaattttagagacagccagtggccggggtgggaaaaggaaaaccgatgaccttcaagggaacaacaatcaaactacaagctgaattctcaacagaaaaagacgaaaggcagaacccgatgcaatggcattttcacaatgttaaaagaaaacaaccgccggctctgaattccaaatccagcaaaaaccaaaaaaacttcaaaaataaaggacgagtagatacttcagataaaaggggccctttctaaaagaacggaagctaaaagatgtggaaaaaaaagagtaatggataaaactaaatgaatatcgacagtattaaaatgtaatatgtgtcttgtgggttttaaaatatagagagaattaaacaacaaaagcacataaattaggaaggaagaggaaataaatttgttcaggtgctctcaggccctacctatcatgatctacaaaagaataagagctccacatgtctaacaggtcaaggatccatgttggaatatgtaaccactaaaagaatagctaagcaaatagcaaaaatggacagctaacacgaggtgaaaagacagaataataaaaattataaccaacggacaaaaagattaaaaaataaacatagagcgggtaggataaaaagaaagcaatgaatcagaggacagatttaagctaaaatgtaacagtcattacatcacatgtacataaactaaatattccagctgaaaaatattgtcagatttgggacaaaaataaccaccataagcagtttatgagagacatattttaaaggcacaggcacagaaaagctgaaagtaagttaagaaagcaattaaccacacaaacactaatccaaaaaaaaaaggctaatgcaaatatcagactttgcaagaaaacaacagtcaattttgcaagaaaacaacatcactaaaaatgaccattccatgatttgccagaaagacatcaaatttctacatctgtatatacgtgataatagcttcagcatgtacacagcaaaaatggacagaactaaaaaggaagggattttcacagtaactgaaacaacagataataaagtatatgtatttttcaagtgcataataaccctttaccaaattaatcacataacgaaccataaagcaagtctaacaaatataaaagaattgaaattattcagggcatgttatttgaccaaggggggaatctattagaaataataaaataaacctgaagatcccctagatttagaaagtaagcaattcacttcttttttttttttttttttttttttttgagatggattctcgctctgttgttcaagctggagtggtgcagtggtgcaatctcggctcactgcagcctctgccttcccggttcaggctattctctgtcctcagcctcccgagtagctgggaccacaggcacacgccaccacacctggctaatttttgtatttttagtagagacagggtttcaccattttggccaggctggtcttgacactggcctcaagtgattcatccacttgggcctcccaaagtgttaggattacaggcatgagccactgtgcccagcctaagcaattcacttctaaattacccagagagtcaaagaaaacatcctcattaatttcaactgaatgctaataaaaatgcaacatattaaaacttgtagaatacagctacagcagtacttagaatgaaatttatggcttttaaagcacacatatagaggaccaacaaagtcaaaagtctattatttgcaaagaataaaaaaattgataagcctctggtgacactcattttaaaaaagggtaatacaaataagttatcagtatcaggaataaaagaaaacatgactattaatcctacagaaaataagcatattatgaacaacttataccaataaatttgaacatttagatgaaacagataaattcctagacaaacataattatcaaaattgacacaaggccaggagcagtggctcatgcctgtaatcccaacactttgggaggtcaaagtgggtgaattgcttgagttcagggttttgagacaagactggccaacatggtgaaatcccatctctattaaaaaatacagaaattagccgggtgtggtcccagctacttgggaggctaaggcaggaagatcacatgagcccaggacttcaaggctgcacgagctatgattgcaccagtgcaatccagcctgggtgacagagtgagaacctatctcaaaaaaaaaaagaaacactgatacaaataaaaatctgaaaagttctgtatctattatagaaaaactttcccacaaagaaaactctatcattactttaaaaagaaataacatcaatcctagccaaactcttccagagaacaaagatgaaacatttcccaattcatttgatataaccagcataatcttgatagcaacatatgacaaagatattataagaaaggaaaattttaagttaatctcactgatgaatgaggatgcaaaaatcctaaacaaaatactagcaaacagaatctaggaatctcactctctctttgtgtacatataaagaatatttggtccttgcaaggttaatttaacactcaaaaatatgcacaattctccacaataacaaaataagaagaaaaatcacattatcatctcattgaataatggaaaaacatttgataaattaacattcattaatttttaaaaaatcaaccattcaggataaaaaaatcacccattcaggaatacgagaaaatctcccttaatctgataaagaatcagtatttaaaaaaacaccaactacagcaaatatcattcttaatgatgaaatgttgacagtttcccctctgagatcaggactgatacaaggatgcctctgattatcacttctgttcaaaaaacattgtactgaaaattctagacagtgcaataaagcaagtaaaagaaatgtgtgtcaactggctgggcatggtggctcacgcctataatcccaacactttgggaggctgaggcaggcggattgcttttgcccagtagttcgagaccagcctgggcaacatggcgaaaccctgtctctacaaaaatacaaaaatcagccaggcatggtggtacatgcctatggtccctgctactcgggaggctgaggtgggaggatcgcctgagcccaggaggttgaggccatagtaagccatgagtatcccactccactccagcctgggtgacagagcaaaactttgtctccaaaaaaaaaaagtataagatttagtgaaaaataaaactcattatttgtggacaacatgtgtgctcatagaaaatccaacagaattttcggctaaactataataaccaataagtaaacttaggtcactgaagataaagtcaatatacaaaaattaattgtaaaaaatacagtatttctacataatgataacaattatgtacatattatctatataccatatgaataataagggaaaaatttaaacaccatttaaataatattcaaataaaataaaatacccaaaaataaataacaaaagatgtacctggcctctacaaagaaaactataaaacaatattaataaaaattaagaactaaataaatgagtttacccaggaattaaagataaaatattataaagatctaatttctctcccaaactgatctacagaatcagtaagatcccaatcaaaatttcaacaaggttgtgtgtgtaaatgaaaaactgacaagcagattctaaaattatattgaaatgctaagaacttaacagccaaaacaatcctaaagaacaaaaaatagaggatttaccacactaaataccaagacacattataaagctgtaataagtaagaaaatgtgatattagctgaaagataggcacacagacccaggaaatacaacagagtcaaaaacatacttatgaaccctgatttatgactaagatgccccttcagagcagtggagaaaggattatgttttagtaaatggcactgggttaactggctagccatatggaaaaaaaaaaaagaatcttgccccaacctcacaccatacacaatattcaattctagatggaattgaggctgaccctaagaaaaggatcatcaaattcccttcccctctggcttcaaactgagttcaaccaatgggagacatcagcaggagactaagggtgagaagagaaggtcaggatatttatgccctaggttctctccccaccatgagctgcctttcatgcctctaaggaaggcaattcctatcaggtagccctctccatataggtacctctctgagttgaggcaacagctctttcctaatgcttctttaaagagcaagatgtttcaagggctctcagtcatcactagtgctgagatactgcactagtcctcatttattttttaaaccctacccacattatttgtaaatctaccctttattaaactctcaaatacctcgtttgagagccttctgtttccttctggaactccaactaaatcagacattatctagaaaagctgaagatatgagttacagatatgcatatcctatcatccaggaattccactcctagttacacaccttacagaaaggcatgcttactgtgcaccaagtacatgtatatggctgttcattgaagcaatgatcataatattacaaacagagaaaaaaacaatgtacaaaacagtggagtaggcagataaattcattgggtcaaaaatattatgatggaatactatattccaacaaaaatgaataaactactcaaacttttaaaatttcacagcctttttgcactcttagaaattattaaggaccccaaagaccttttgtttcatataaaatataaagttttataaatatctatttattctaaaacaataaatacattacatgttaacataaataacatttcttacgaaaaataacttttcattttccaaaacaaaagtgagaagaatggcactgttttatattcttgcaaaacttttattgtctggcttaatcgaaaacaactcaattttcatgtctgtttctgtattcagtctactgtaatacgttgttttggatgaagcatatgaagaaaagcaaagcagacttacagatatttagttggaagagagaggaacggtttaacagtcttttcagataaccatggatatttatctttgatactactaaaacttaacatgataatttccttttttcttttttttttttttgagatggagtttcgctcttgttgcccaggctggagggcaatggcacgatctcagctcactgcaacctctgtctcctgggttgtcctgcctcagcctcccaagtagctggggctacaggcatgtgccaccatgcctgactaattctgtatttttagtagagacagggtttctccatgttggtcaggctggtctcgaactcctgacctctggtgatccgcctgccttggcctcccaaagtgctgggattacaggcgttagtcactgcgactggccaacaagtgataatttcttaaaaattagatgtagtgtagcatctgaaaccctatcagtgaacttctcatattccactgcatcaaaatctacggtttaccttgcgtattgaacaagtctttttacccatgcatgatttcataacaccatacacacatcatctggagaatactggctcactaaatatgcaagtctttcaaatgatgacattttactgtatgacatcaaaaaaacccactttcattattatcaccatctatcatatcagaaaggtttttaagtattgacatgctgtcaagttcatggtgctagatacaagtttcctaaaattctaattttcacataaaaactcaaattttaccattggcaacaaatacagtcggttgttttctttgaagtgacaggctcgttttgttcattttcaagaaaatgtctgccaaatacctctgtgtgagtaaccatagtttatcagccactctatcaaatgaaaatagcattctacttaaaaagtagcaagtttagcttgcaactcaaataactacccacatgctcgtcctcaaggcaaccatcatacattgatatgcatcaaaagtcctttaggcatacttaccattttgtcacactgaatattaaaaagatgtgttctcaaaggttgagatttaataaaatcaattatttttcctgctttaccaaggacattcttgagtgaaactgcattttttttaaactgccaataagtggcagtgaagaataaaatggtgctagtacagtttggtactagtacactgcctttattcatgataaggcgtcaggagttttattcatcattgcttttgaaccgtcactacaaatatcaacagtaaaaagggccgatgacatattcgtattgttataaaaatagttttgaccttgtgtgctcccctgagagggtctcagggaaatcctagggggtccagaccacactttgggaactactgagttacatcaacgtaaaacagtaagaataaatcttaaaaatgtaatcctaagccaacaacaacaaaagacacaaaaggctacacactatgagattcatttatataaaaattcaaaaacaggcaaaactaggcagggcacggtggctcatgcctgtaatcacagcactctgggaggccaaggcgggtggatcacttgaggtcaggagttcaagaccagcctggccaacatggtgaaaccccatctctactaaaaatacaaaaaaattatctgggtgtggtggctcgagcctgtaatcctagctgatagggaggctgaggcaggagaatcacttgaaccgggaggcggaggttgcgatgagccgagatcgcaccactacactccagcctgggcgacagagcaagactctgtcccaaaaaaaacaaaatcaaaaacaggcaaaactaaattgtcatttagggatgcatacttcattgataaaccacaatgggagatttttcacacatttttctcagtaactgacaaatcaagcagacaaaaagtagcaaggctatggaagatataaacaatacagttaaaaagcttaatctaacagccatatattgaaccctatatccaacagtaacagaatacacattctttgcaaacacagaccactcataaaagctgacaatatactacacaaaaaagtctcctatatgaacaatattctgtgattgagatgtaattattttaaaaatgaataataaaaagataacttaaaaatcaacattttgaaattttacaaatacacttttaaatggttcactaaaggaatcatcatagaaattagaaaatatttagaactgaagactaaatactacatatagaaacttgtgatgtgagctaaaacagtattagagaagacatttacagtttttaaactgttttattaggaaagaagatgaaaattaatgacctgagaaattgggggtcagagagaataaatccaaagaaaaggtaagaaaataaaataactaaacctgttagcaagctaatttgtttaaataaatttatgttatatcttatctatagaaatatgtccaaaaaaggttctacccaaattattctagtatctatattattgaacctcaactgatcatcccaactggctggttaattccaaagcccaatacatatttatcacaatgctagcatggctctccccatccccatcctcttaacgacacagacttctttggagtcaagttctccaactagaaccttaggtaagaaccctttctccacccaactaattgaagatatgatcctcccaaaccccgacctctgtgtgaccttgagactttgagaaaaactcagattctcctgtagaaggaggctgtgctttgaaaagaaactcagaagttcactcaggttgtccatgagttaagttggaaaaaaatccaacaaactcagtaagagataactgtaaaatctctgaattatgtggaatggctgcaaaacaaaaacaaaaacaacaaaaaaacacctgtcctttctttcattccttttctacttagcaccctttgcagctacctccagctgccagtgtgggaaattaaggtgaaggctggcagaaaagcagcctggctcctcttcacactgcacagtttttgatggtgacatcacatttccatacctgcacaatttattgcaatgggcttcatctgaaactgatcaacctctcaaatcttacatgtcgacattacaatctgaccataacctcttaattttgcagttttctcactccttcaccccatgatccctgttcctcaacattctgaaaacttccaggccttgatccatcagcccctcccacccagactcccattcctaccgaacgaggactccaaagacggccactgaatccccctctcactgtggaagccatgcagatccaaagccccccacactcacagacctgagacaatcccatggtctggcaaaatcacatagccaggcaaaattgcggtcaccctacacgtggttattcaatctcagctggactctcaacgccactctccagtcgctttcttatccctggcttagtctgaaattggaaaagggttgttcctaagcctttccattctcctcaagccaccgttccaaccctgtggcctcttactctcctacctcatagagaagaaaataagggagatctatcaggcttggttgaaactactctggcaaaggtcatgaatgaatcattcttttctcagcttttctcgtggctagctgcctcccaccagtcagactccagctcaaatgctaccttcacaaacagcccttaactgacccgctggagaaagccattctcctacttactctctccatagccttgtttcatttcctcattggacatttcagaaaggcagagagacctggcctgtcttcttcactgtactatccccagcacctagagcacagggggtgcttaataaatattccttaaactaattctgtaggaaaactagctctgatttactgaagttttgaattattcatgaccttcagtagcacactccttgtgtaaaattcaacaccccttttccgatttcaaaccacgaccatcaacttttcttcctacttcccttcatcgtcagtttaagtcccacacgtgccaccttcttcaaatcattgccacctctgtctaccattccctcaaacctattttgtcattttagatttttcttttagtatctggcttacatttttcctctctacattatccctctctacattatcccttatgattttcaataacttcttctacatggtcagtgacaaagtcggtgactccaacattcatgtcagctgctaaccacaggacgaccccagccagcctcaatcttaccctaattgtttcctcttaaaaacctcagcattcatctttcctacttccctactacatccagtgaagctgttcatgctgtccacagaaatttctcagcttacagcccctccactttactcttgggtatgcacttgatttttgaccgttttgctgtctgcgtccaattaatgcaactctctttaccttattaaaccttctggtcttcctgttacatgctctctcccaccttattatgctccagaagaccactacaaaagtcttcaaatgccattttattatatgtaattgcagcctgtattatttaaacttaatgtgttaagattcaaagaaaagcaagacatgggtaagcaagcaacaaatctttctatcttaaagagaaatagaaatgttaaacagagagtttgggtattccacattctcatttgattatgacaagatgtataatttacattaattcctagctaccacttcacatgattatttggaagaaatacttacatagattagtcctgaatagtagcgatccttcagattatgtaaaacggaagcttcattcaagcatgtcaattctgccatatcctccaccttggaaaacttaggtgggttcatcttctgaatatcatctttgttgaccattgctttctttccattctctgccaactccaccataacttcatctccccgttcttctttgatactagctgcctcaaaaccatggcgttctgatggaatccacactagctttttagctgtccaatcagcttgagtggcagggttgtagatgacagccctgtccacaaagagatacctctctggatcctcgagtccagttctctgcgccattgtaaatggaacgatccaaaagcaattgcctctaagagaagaggaggagggcaaaattagatgtttaagaaacaaaagaatgtacacgtttttcttttctaagaaacttaaaaccttagattaagcattaactctgtgttaaggagctggggtatacctcttcacagccatactaaccgagtttccaaggtaaatttcagcggtgaccacaaattatggctctggttgtctgatgggtttgccctcagttactgagggcaaaaaaaagaaaagaaaagaaaagaaaaggcaaagttacaagttgacccttttttttctttatctcctctttcaccctcaccacaaattaaacagggagttaagaagggaaaaaaaaaaagaaaacaaagatgggtaataaaaggttcatgaagtggtaccagaattaatatgaccacaaggaaacagctacaaaaacacatgattgtcagaagagtaaagaatctaaagaatctaaaacatgcctctcattctaccctcagataacagacttaaagttcttcttatgaataacccaaatcagtctccctctagcttttctatggccccatgaggtcttaatgtgatcaactgggaccacaaaagacaagcataacttggcttcacacggcagccttttgaatatgtcatggtagcagttcaggcctctattcccatcctgcagctcctccacccctcattcaccaagactccttcccctgccggatctctcgcctaaacagactccaacatgctgcttgtcttccctctaaagtgtgtggcccagaagcaaacatcatagcccagatatggtctgaccagtgcagaagaaaaaggaaccatcaactatcttagccacattgaggaaagtactggttctgtgacatttacaattaatgtatctcaagacctagttgttttatttagcacccatttaccattggctcacaaagggctagcagaggaagctccatcactttgtggctaagctatgtcccctcctctacttgtgcactggctttctggaccaaatggcaggattttacatccatcatctttctaatgtgactcatcatgattgcctgacaggatctttttgggatttgataccaacttaaacatttttgctgctactccaaattccaggttattataaatttcataggcatggcttccatcacttcattcaaaccaacagaagaagccaactgagtacctactcttgctctatcaaatccccacttctcccctctgttcactccactcccctagccaaaaatgctagaggttctttgtaggcaagaggaaatcataaagtagtctaaggttgttaagaggttcttgagtccatcagctaatctcaacttcaacaaaatccctgaaatggtataaaaatattatgcacttagcgtgtgtatatatgtgctataacgttctctagattctaaagggctctatctgtatcctaaaagattaatcactgatagtggttacacattcaaccaacttctgggcacaatggcccataactgttatctcagcaacttgaggggctaaggtgggaggagtgcttgaagccaaatatttgagaccagcctgggcaacatagcaagatcccgcctctacagaaaaatttaaaaattagccaggcgtgttggtgcatatctagccctttaactactactaataatttactagaaccagctgggtgcagtagctcatgcctataatcctagcactttgggaggccgagatgggtggatcacctgaggtcagaagttcgagaccagcctggccaacatggtgaaaccccatctccaccaaaaataacaaaaaattagccaggcgtggtggtgggtgcctgtaatcccagccactcaggaggctgaggcaggagaattgcttgaacctgagaggcggaggttgcagtgagctgagatcgtgccactgcactccaggctgggtgacagagcaagactccgtctcaaaaacaaacaaaaataaatttaaaaaaataatttactagaaccaaatagctaagattcttcagaaattacttgttgcaatgtaatgcgttacaaacactcatcttctatagtagcggctgtcaaattcaggcatgcatttgcagcacctagagggtttattaaaatacagattgctgggctctatcccagagtccctgattcagtaggtatagggtagagcctgagaactattttttttttttttgagacagagtttcaccctgttgcccaggctggagtgcagtggacgcaatctcagctcactgcaacctctgcctccagggttcaagtgattctcttgcctcagcctcccaagtagctgggattacaggcaggcctgcaccatgacccgctaatttttgtatttttaatagagatggggtttcaccatgttggtcaggctggtcttgaactcctcacctcaggtgatccacctgcctcggcctcccaaagtgctgggattacaagcgtgagccaccgcgtccagcctgagcctcagaatttgcatttctaacaagttcccagatgctgctgccactgctggtcctgggacacatttgacaaccattgctccaaagttctgtggttgccatggtgcgccactgctaccagcaggtatgttagagtagaaaaagaggttgaaaaccaaattctagactaattcataacaatttaaataacatgttgatgtcttaaaggttatagacttggataaaacaaaaaccgcaaaataagatgaaacaaaaaatcacacaacatgtgattaatgttattaaaacttctatacaaataaaattgctaacacattttatacctaaacttgcattagtcttctaagacatcctctttggagagggcaatacagaaaacattcatagatacatgtacattctgcataacagttttaaaagcctctagggactggtctaataacactattaacaagttgtctctttccaacttaaacgttgcacactggtaaaaagaaaggaggccaggtggggtggctcacgcctgtaatcccagcgctttgggagggcgaggcaggtagattgctcgagtccaggtgttcaagaccagcctgggcaacatagcgaaaccccgtctctacaaaaaatacaaaaaattagctgggcttggtgtcacaggcctgcagtcccagttcttcaggaggatgaggcaggaagatcacttgagcccaggaggcagaggttgtagtgagctgaaatcacaccactgcactccagcctcggcaacagaatgagactctgtctcaaaataataataaataataataataataataataataataataagtaaaataaaaaatttaaaaaaaaagaagaaaggaggcatggcttcaaggtgggaaacatcacaggtaaatttgagaacaaataataggatacacactccacctttcagaagggtagaatctattaaaagaaaatattcaactataacaaaatatgacaagtttctcttactattcttatcaggtgtaaactgcatatcctacagagcacttaggaaactgtcttgctgtcagtagacacgcacacacttcttaaattttacactggacatgtaattagatgcttaaatttagcaggtgactataaattagaataatttaacaaataacttctagaacaggtctagaagcagtagattatatatcttaaaattattttatcaaattgggacatcttacatattatcagtactttttctagatggggaaatgcttgtaatttagtattttaaaaaacccagtagaacacaaaagtgtaattacacagcatgttcccaattttgtggggaaaactacatacacgtgtgtattttttttttaaacggaacaaatattcattgggtctttactgggtagtaggattaccaatgactttcaccttttcagtctcttctacaactaaacactatgaggagagtcatctgttccacgctgtatcttgagcattttgtctagtccctggtatataacaggggatctgtacctattgatcaatatttacgtgaatggtcccaaccctcatagtgaaattcaacttctccacaaccaaaaagctattattccttcaactcctgacccaaatgccatcctttcagaagttcttttcaggtcaatgtggcaatttaatccttttccttctcctaacattttgtactgttctcctgactttcttcttaccctaccctgcgttgtaccagagggctttgcagctgttaagtgttcatattattgtttacctgatagagttcatgagaccattggagatattttgttcagtttaattcttcacttgtaattgtcaaatacatttatttcactccataatacattggtacccaatctggataatactggtgtttaacagtgtaccactcaccagtgatttgctttgcaggaaggacaacactatgatttttaaaacagcagataccattgtcatatatcactaattatggccaggcactattctaagcagtttacatacatcaactcttaatcctcacaacagccctatgaggtaggcactattaatatctccattttacagatgaggaatctgaggtacagagaaagccaataaccagcccaagggcacacagctaacaagtagcagagctgggattaaactcagagttcagctccagagtacacactacaatgatggaaggtgacatggaggaaattttgaagggtgtgtagtgtacaatgctatatactacctttctactaaataaaaacccaatcaattacggcttaaaaagtataggcttaaccaatgaatcatctggcaaaggttttatatattttatagaaaaagatacccataacttaggggaaataaagacaaacaggaatctttttgttagcgaacataaagatggtctgagggttattagtgtcattttaaattgctgcctaattacaattaaatcatttatctgtgtatgaattagccccctacagagccaaagttgccatccctttcagtggtttgacacacacacccctggggctccacccccaggtcatttttcacttccaatgaaatgtcacccagcaaacttttcaaatccctcccagcacctactatgagtgtggacagaggcaaacaattcaattttatgaacggcctgcacatagaaaggcaaacaagaaggatggataaattatccatgacagagcatccatctataacagatgagctaaaacagaactgtcccaatttgggtactgctaccattgaggtcacttacatgacagggctggacgagtctgctaatttatcaaaatcctgctcaacccaatgatcacaaacacaaaccaaacacaaaaggccactattgctacttatggcctgccccatctcccaattaatatctctatactgtgtttaatatttccaaaactaggatccaacaccaggaactttaattcctcacatgtgataaagtgcataaaccgctgaagcatatagtcttccaccctacaacgtgcccttcaagatttcctccatctcaccttccatctcagctgccttcgttataatgatttccctatggagcccaaatgaaaagccaggctcgcaggggtcacatccttctgctgccaaagctcgtgctatatcgcacaattacaccatatgctttctccagataaggacggggaagaactgaatttaagatgcagaagtaaggagatgcataaaatggccacttttccagaacccgagacaggcagggcatacttaaacatcaaaagcaagggactcaaagaataattaataaaggcagattgatgaaggagataaaacaataaatagattataaagttttccagagtgagatactatcaagaataattaaacctgactcaaagaatcctcagtttcaacgttaaaaaacaaaatctcagcaaagccaaagtattatgtttggtattacattattcagcgaaaacagcagtctttgtttcatctgcagtctgcatctaccccgcctgctttcccctaccccaccccagcccaccccacccccttccatccaccgcagtgatcttgaagggagctgcagaggccctaaagaaacagagataacggctgtaggcagaggccacgttatccaaacctcaccagcccggtctgacccgccgagtcgccaacctccttcctaaggccctagttccaaacaggcctggctgggggcctcccgcttcccagggccgcatccgcccaccacaggcccacaaagcccccacaaatgccaggactccgcggcttcaacttccctccgaaccaattccagtccgattttatgggatcagggtgtgacccccaactgcagaaggcaatgaagagactgcggcgagccattcccagctcgcttacacaataaagggatcccgaggcgagtgctgaccctccccccggccgtcctgctgcagcgcgccccgccacatttcccgcctcgccccctcaaaccgcctgggcctcgcagggcgtccacccccggcctaggcgctccacggagggcgcggcaggacgccctcctcccgcgctccttccccggcgccggcggagtccgaccctccccacgcccgcggccggctccggagcccctcacccgccgcgcgcttccccggccgcgcagagccaatgccctcctgtccctccacccacgggtcgggcgcgcgccgcccgccttccaagcccatggtgaacccctctggtgctgcgggggaccggtcgcgccaggcctaacccacccagcaacccacgcaggggcccttcctgcccagcgcccccccaccctaccgccgggactgcgctttccagccccgcttagaatcccctctcttcctgggaggcagacactggctcgcggggcacgccgagacctccgccgggacactagcccctcgacctcgcgcccccagggatcccacccaccgagaacctggtcctcacgtccccacccccagatctccatcccccagccccccaggggtcgccctcctgcacacccaggccctgacccccgcgggtttcacaaggacttcattccccgctcctccgggagtctctccatctccacccactgaggtcccagtgcccccagcccaggaccctgctcaaactaacctaaggtccccgcagcacaaaccctacagctcagaagcccctctgtcttccccagctcccgcttcggtcccccgttcctgtcctccagagccgcccgggacccctcagcccaggagccattcctccctccacaaactgtcccccagccctgggccgtgcactcggacccgggtagccgcacctctcaccttcagccgaagatggtggcgcgggcgcacgtccccagccgcgaccacagatccagcgcctcagtcccaaacccaccgctgcctccgccgggctcctttagcactgct

SEQ ID NO: 206 - DNA, 156558 bp, Homo sapiens; identical to SEQ ID NO: 205

SEQ ID NO: 207 - DNA, 156558 bp, Homo sapiens; identical to SEQ ID NO: 205

SEQ ID NO: 208 - DNA, 32327 bp, Homo sapiens; identical to SEQ ID NO: 204

SEQ ID NO: 209 - DNA, 348154 bp, Homo sapiens
tgttattaactgtaagactgtttgaattgtcaggtctttgtggtgagctgaattctgcatggcagtgcttactgtgcagaaaggttgcaatgcctcactttgccttaatccatgttcctctaacttccttactctttctctcaagaggaggcaagtggctgtggcggccgcagcagtggctgatcatcactgaaaataccaaagaaaagaactgagctgcctccttcatattttttccattgaggattaatttaccgtgctttttcattttctctacatcctgcaaaagtttttttctctcctaagaaacaaactatgaactgattgttgaaaaaaagaagtaaaaagttttagcacagcttctctgtctcttcgggacaagttagaaaattctgaagtgagccgaagcatagtaagtgctttctttctttttaagctacttctggggagggaggaggctattgtaatggtaaatttcactccgagaggaagaaagggttgataatcaatcaaaaatgaggtattcctttgagtatttgtgattttcttactatattgtaagatgcttttaattttctctgtaaaataggcagaaatggttttagtgtgtgtatgtgtgaaataaaagctcagaaaagcaatcttcagagcgccactgaaggaagttttgacgaacggagtagagatgtataccacttgggggcttcagtgagaacccagaattcctggaggaggatttacattcagaaatgttgaagtgaaaattccttctggttcagcatcttggagttcagcttggaagaacattttacgtatggaagaatttgcttctccaaacctctcttttggccattgtgtgtcctgaaggatgggacaacttgtgctgtagaagcactgcttgcctgagtttgcttcaggcattttaaatttaacttgagggatcatgtgtttggcatgatgaggaccactgaagacttccacaagcctagtgccacattaaactctaacacggccaccaagggaaggtacatttatctggaggcattcctggagggaggagctccctggggttttactctaaagggtggcctggagcacggagaaccattaatcatctctaaggtatgtttctttttccaatattgcctttattcaaattgtttttttcaacttgtcagatttgtcaaaaatgcaaaataatgagaactgccttaatataacttaatttgctgtttcatgcctttctgattatctagaaatattttggatagcctgggatttgaaagaaaaatgtgtctagctcatttattctatgaaatccgaagaaaaatatgcctgtttgatggataatcttctctttttgtgaatgaaatcgcatacaatcagttaccacatgagcttttcagttataaatcagattaaagattaataacatggttaagatggtggcatggtatatatttgtgcattcaaaaatatctgctttttctctcttcaactgaaaatagcatctaaaaatattttaagtttgcttataattctggataatagattgcataaataccatgtgttgctttttttccccacactcagaaaggagaattaaatcagctttcagcataactcaagatcaaaacatttctgcctctcctatttatctgtatatttgaatccctttttaaaccttagtcatcctgcagcatacctcaattcttcatttatcttttggtgtgggtagtcataccaatgaaatatttatgtactggggttaatatttctatttttctcttaaactacagattaacattacttgttataatattgcttttaaatttttagagtatttaatagtctgatacaatagattataatggcttttcacacatgtgcattcatcaagaaacatttgtaattaagggagaaaaaatttttaatttgagggtgggaagaaggtaatatggattgcatttgagctctgttattggttcaggttacttttcatatccccagaaataattccaaaaggttatttttcaaattactgaagtaattcttactgtggatgagccagggagaactgggtttcacagtgataagccacgagtgcacgggacaccattataagttgtatgacttttccttaactttcttaagtaaaacaaaaggatgtgcatatgtgtgtgtcagttaggaaggcttccccctgtgaaaaaaattcaaaaccgagtttatagtggctctcagtaaattggggtttgtttttctcatattacaagaagtttggaggtagattttccaggcaaggggagcagcagctcaataatgtgatcaaggaccccacttatctctccactctgccattcttatgatgttggctttgtcttcatggttgcatgatggatcccacaactccagcattgattgcatcttcattccagacaggtttttggctttttgtttctcattagacctttgctttcatctcattaaccagaactgtaccctgtgcctgtctttaggccaatcactggtaagaaatgccagtgattaatacagactgattaggatttctttcacaggtttctacaataaggacctactcttcctgaagtcaaggaatcattgcccactgtttgaatgatttgaggttctttttgcaggaagaaagagggcatggttgctgaataacagataattctgcaatgaacataaatattgtctcggcatttaaaaagtctagttgtacacaatttgcctgtcccttaatgataaaatattctgtatctatacactacagtatctgacagtttgctgacagaaaggtctaatcctcccactaatgagccagcttctctaagcctccattttacctgcagaatggggctatcctactatctactttaatgggttgtgtttaaatgcaaccatgcatttaggttagtgtctagtacacagaaggagcaaagattatgattattgcttttcattattctagcagacatgtgtagtaggagacaggtctggctgctgtaaaaagatccaaaataacaataatataggaatttatttctctgacataacagtctgagcataagccaaaccaaaagatggctctatgatgtcagggacccaagttccttctattttcttacttccatcctggagtgatatctcatcttcatggtccaagtgacttgccaccacatctgctttccagtcagtaagaagcagggaagagggaaaagagaaggcaatctcctttctttcaaggatccaatctggtccaatgtgctctgtccaatatggtggcccacagtcacatgtgactatttctatttcaattaaaggtaactaaaatgaagtaaaaaattttaaactctgtttaaatgttcctcatttgcacttgttgcattccaagagtcgtactgttccgaagctcttgaacatcttcccccatgttgtctgtctggcaaactctttaaagctccatttcttcttctctctgaggttttcctgatgtcacccaagttgagttccgtggtctcccttctacacttccatattatgcatgtattacattgaatcataaaattttatttcgttgattgccttctcagaagtctgtgagcctttttagggcagggactattttttttttttcatctctatcacatctaaatcagagcctaggtacacaaatgtttgttgagtatatgaaagggcatggctgtgtcttactcattttgcattttcaggatctagcacagtgcctggcacagagtaggcactcaataacttttactgaattaataagcaaaagaccaaacagaaccaatgaggatgccaggcagacctccatgtggggcatgtattagtttcctattgctgctgtaacaaattactacaaacttatggcttaaaaacaacacaacttacagttctgtaggtgacacacctcacacagatctcactgagctaaagtcagtgtgtcagcagggctgtgttccttgctggaggctctaggggaagatgtgttttcttgccctgtctagcttctagaggctgcccacattccctggctcatggtccccttcctccatcttcaaagtctgcaacagcaggttgagtccttctcaccctgcagctgacctctgactgcctctctctttcacttttaaggcctcttgtgagtaccttggacctaccaggataatcctggataatctctctattttaaaatcagctggttaatagccttaattgtatttgcaaccttaattcacccttactaaataacctgacatattcacaggtttcagggattagaatgcagacatcttaggggagacagggcattattttgcctaccaccaggcatttgagcattggtagaagtctatgtaattaaggcagtaccagggatgagactaaagtgaaatgtggtggctgatcatgcgtatactagatcttctctctaagacaatgaaagaaaatgcacattagctcatacactgctaaccagatgtctactattctcccaagttagggtgaccctccattgtaggggaagggaagggatagtacacattgagtcacacatatgaaaggcacaaacacattatacaaggcagctataaactgccaggttatggatggcaatataataaatgaagtatcatttttctttagatataaatgaggcaggagaatgaatggccgtaaaggatctacaaagggtaacaatagaataaatcatttttgaattgctttctttgggatttaatatccttggaaaggaaaggtggggttgtggaaagcgcctctgtaatctgtgaacttcaaaaagaaagggtaacttttaaaaaattgtcattgtaagtggatgctcaggtaattcaatagtccaggaagttggtggcatgattttattatgattcacttactctgtattgtggctcagaaaagcagttccacctgcagaagagatgcacctgctcccagggctcataagccaagtaacaacaataaacaacaacagcagcaactgccggtacttatttagtgtttgtgatgttccaggctctattccaagagatctacgtgttcacccatttaatttccacaacttcacagagagggtaacactcttatcccaatgttatatgtgggacacgcacccagaattaatttgagtaacttgctgaagctctcatagctactaagtgatgcagtcaggatttgaactcatgcattctggttccagagtccatgcgcctcacaccctatgccattcagtctccattgcctactgaacatttggctctctctagattctagagctattatctgagtgaagtatgggattgatatttcattatataagtttttaaatctattcgggggaattttaaaaaatacatagtccaataagattccataaaataggtctgactactgctcagtcaactgctttaagtagttcaagacccataaaataaggggacacctgctgttcttggcaaatatattcatggtgtctccacctgtagaggcatttctttgtgcttttcaaacatggacttcagaatttaaaggtaggccactgccctggtctcttttgtctcttacatcatcaacactcagcaatgtgctggtcaaagcactcctccatcagtgcttatatttctgatttctactcccctggaaggtatctgtgctctagctggactatctctatgccatctcattataaatcttgctggttccatcttccacactgtcacctctccttctccaaaactgcttcctccacctgtaatatcaccaccttttttctatcaatccaaatcttagcctccttgtccaccaagacttgactcactgactctatttcatcaacagctttccattctttatctatggaggcgagggggaggtgcttaaggctcattttaccagttcttcagccacagtcctgagttcaatttgtttttttttttttttttttttgagacagagtctcactctgtcgcccaggctggagtgcagtgcagtggcgcgatctcggctcactgcaagctccgcctcctgggttcacgccattctcctgcctcagactcccaagtagctgggactacaggcgcctgccacacgcctggctaattttttgtatttttagtagagacagggtttcgccgtgttagccaggatggactcgatctcctgacctcgtgatccacccacctcggcctcccaaagtgttgggattacaggcgtgagccaccgcgcccagcccctgagttcaatttgaaatggatttttaggcagttccccaagacctggatctggttgaggacccaaagtcatctttttcgtctccttccaactaccacattagatcagctcgtcattctgaccttttaaaatagccaatcctttctgactttttccctttcttgctttttcctttaacatcctttgcccttcctactagggtagcctcatctctctgctgctcttcagctagtttgtttcttcccttattgttcaatctatctttgtcctgcctttgcattcattcttctttcctcttatctccccagtggctttattttttattttaattattattttttgtttttgagatagagtttcgctcttgttgcccaggctggagtgcaatggcacgatctcggctcactgcaacctctgcctcctgggttcaagcgattctcctgcctcagcctcccaagtagctgggattacaggcatgcgccaccacacccagttaattttgtatttttagtagagacggggtttctctatgttggtgaggctggtctcaagctcccaacctcgagtgatgtacctacctcggcctcccaaaattccgagattacaggcgtgagccaccccactcggcttcccagtggctttttattatacaggtatataaaggtcctataaaggtagttgtttgcatttggcgtcctgccaataaattgtactcgttaaggccagatgggttttactcatgctgtatatatttcttctcttagcaaaatctttctcatttacacatagcaaatgcttaataaatgttaaatgacttacaggattgtacagctataggaaaattagcaatcatgtaataactttcttcgtacacagagagaaaactgagatgcaaaaaaagttgccaagatggtttcagtcttagcaaattgagagtatgtgtgtatctgtgtgtatgtaaagccccagctagtaaggaagtaattgctttctctgattgtgccctttatagttttttttttttttttttttttggagacagagtcttgctctgtcgcccaggctggagtgcagtggtgcgatctcgggtcactgtaagctccacctcccgggttcacgccattctcctgcctcagcctcctgagtagcagggactataggcgtccgccaccacgcacggctaattttttgtatttttagtagagatagggtttcaccgtgttagccaggatggtctcgatctccttaccttatgatccgcccacctcggcctcccaaagtgctgggattacaggcgtgagtcaccgtgcccggccccaccctttatacttttctatgaatcctagctcccctgttagactgttaccttccagaagctaaagacccttcattgattccttttctctctctctctccccttcccttctttccttcctccttttctttttattattcgtggtgcttaaactatacgtaacaattatgaaaatgaaaatgtgaatgaataaagaggaagataagtattagagaggatattcttaaaaatctttgttagaagctacctaggccagtgtgcacacaggttactagaaaaacctgtttaaaaactaaggcaagcaggttaagttgggctcagtctgaccatgtctttcatatgcacatatgtaatgtttggtaaatgtctgttgaattgaattagattgagaaaaaagggaaactcatgtttttctttaacttttaaacctttaaaaattaactattattttagttaaagtcttacgcattttttagtacaaattaattttgatatttcctatcaatgttgttggaaataacttttattcaagtagcatgctgacatgctgtaccaaatgggtcttagcatcagtaagaactctgctttctttcacagctaatagattcccaaggctttgccttctatgcaggggacacaatttattttaagaaatattcatctcattttagtgagcccacagtgtgattggagaggcataatgagagactttctatcaatttttgaaaaaacaaaacctcaaaggacatgctggatcttaactaatccatagacagactcttccacatctctccctttgatgtagttccaaacagtgaacatcttatccaaagggctgcagtgcagagtccttgttctcccacttggttcatcccaggagtccatccatctcttgtgctctgacatcccaggcacttctcaatgaaacaaaatgaggcaaagattctctactaaatctaagcactgtttctccccctcttctaatgactttctccacaaaggctacatgggtacgctgtggatcttggtttgtagaatggaagtgattcttttctgccttcagaggaagctttcctgatttggcagaccgatgtacagaacactctgtcctgggcatctgaacctgaatttgcacttatgtcaactacattttttcattcctcaatatctatttgttttcttctccattttcagcagtatttttttcttggagatttatgagattatttatttattttgagacaagacttcattctgtcacctaggctagagtgcagtggcatgatcacagctcattgcagccttgacctccctggggtgagcttcttacctcagcctcccaagtagctgggattaaaggtggacaccaccacacccggctaatttttgtagaggtggggttttgctatgtttcccaggctggtctcaaactcctcagctcaagtgatctgcccacctcaacctccctaagtgctgagattgcaggagtgatccaccacgcctggcctaaacctttatttttgaatgctctttggtgcatgtatattaatttatatttgtaatttctatgttatatatatgtatatatgtatatatatattttcattttaagtgaggttttccagcatagaaaaaagcttacatcccagacaatatagggctctgagtgggaataaacaagttttatttctaccctagcttttactggctatgtgaccatggcaagtaacagccttcttgaacctcagtttccagtttcctcatctctctttctttctttttttttttttttttttttttttttgagacggagtcttgctctgtcgcccaggctggagtgcagtgacacgatgatcttggctcactgcaacctccacctcccgggttcaagcgattctcctgccttagcctcccaagtagctgggactacaggcatgggccccatgcctggctaatttttgtatttttagtagagatggggtttcaccatattggtcaggctggtcttgaactcctgacttcgtgatccgcctgcttcggcctcccaaagtactgggattacaggcatgagccaccacgcctggccagttttctcatctttcaaaggcaccaggcatggtggctcacacctgtaatcctagcactttgggaggatgagtcaggtggatcatttgagtccaggagttcaaaaccagcttgggcaacatggcaaaaccctgtctctacaaaaaatacaaaaatttgccaggcatggtggtgcatgcctgtggtcccagctactcaggaggctgaggtgggaggatcgcttgagcccaggaggtggagattacagtgagccaagattgtgctactgcactgtagccaggtgacagagccagacattgtctcaaaaaaaaaaaaaaaaggaacattcttacctaatgaagttgttataagtatccaacatagtataagctatgcaatagtgctttgtaggtatccagcataggtaggcaactcatatgccaaagatgatacttggctgattttctgtatcatggccagcagttgctacctcacactgaaacactgaacagattattccctgccatcatagagcttatattccaacagaaggggactggcaataaacatgtttgtatatgctaatttcagggtgtggtaagtattattaagaaaaaaaatacccaatacgatatgttccagagtgatagtgtctgtgaggtagaggtatgccacatggtgattagagaagggttttctgaggagatgacatttgagccaagacctaataagaaataagaagccagacatgcaaagaggtttataagttgggctgaggtaggagagtcttagaaagttctagaaacaaaaagaaagtcagtgttattggagtacagtaagcgagagagtagtatgagaaatggaaaggtaggctgaggtcagatcacataaggccttgcaggctgtggaaaggaccttggactggatctaaatgcagggtgtgagggtagatcgcaccaagagtctttctctattcatggtgaaatggacagacccatggcaggtacttaaaccctgggaggtttttagtactggctcttaaagccaccttcttcctccctctcatgtacatttctaaggtacttcctgggtctacaacaggacagggctttccaaaagacaactgttaaccaaaagacaactgtcaacatcatagtaacttagggaatgatgcacaaagaaacagtaaatactctctttgctgttgggagagttttccccctccaccccataactcttgatctcttgggttatttttcactctcaattgacaagacttcctgggttgcttttatcaccgtactgtcagtaacttgactgaggtcctgctctgtaacaggcatgctagctcatgtaagcattgcaaaactctgggaagtcctataggtggagagactggactcttgctgaaggtcataaaactactaaggtacacatctaagacctttttaactttcagcctgaaaaatttctttcaaagtaaaaactgcgttgtcactttgtgatgccaaagaacccttccatctatgttaccccatatcttgataaactggtaaaaaaaaaaaaaaaaagtggaatgcatgaactgtgtgcaacagtcagtcaacttggtggcatccttaaggtgccctgctcggtgaaatggcggcggtgggggatgcacatctacttctattaacactgggagttcaactgggctctctgcatcttcccaggtgctgcttcctgctgctttttacttctgctagactctgaccactctggttgtttgggtggggtatatcccatcacatggataggccatgaaaaaacctcaacccccaaggcctggtactcaaggagaaatactagacgaacattagatggtttaaagctaacagggactgaaaccagttaaaagagggaatcagacataagttgcaaactgatagaacaatgatctgctggggcacatgaggttcatgcctcccgacatgctgatgagccccggttatgagctgggcaccacaactgatggtcttttatgaaggagtgctctttacaccaaactttatctcattttggttgtccctttctagcccttgcttagttcaaaatgtagtacatctgctgtgctcatccagcttcatctactgctgagttggctgtgtccacgctcaatctgtctgctctggtttcatgatggtcactagcattcactttccctgcaaggcctactcgccggctttcctaatagtacactctcttggcacgatcctgggaacttcacgtacagttgttaccctcaaagccattgctacctgctagggtcttggttcaattggcctcatctctcactcattcttggttcctggaaacctggtacagacagatcctagtattctaaagatctcaaaatttaaaaatcattgtgacatgaatttgaagtcaaaacccaggcaatttaagtggaaataagcattcttcaggttagtcaaagtgcttagcactttgtatattaaagtgtatcctgagccacacatttgctagaaggtaagaagaaaaattggactctagaatcaattgcctttctcttttcctttgaaaagttaaaatttttaatgaaagaagttgtgtgggtacaatgtaagcttttatcatcttgcatgtgtcctctgagaggttcacatttttgaggccttgtctcatggaaactgggaaatgagcttctggaattcagacccaggatctggctgcattccagaaataaatatacatgttgggcgttgagatagacaattaaaagaataggagagtgtgcaaacttttgagaatgagaaggcagaaaatagactcttttctctcatgctttgcttttgcttttgtttattttttatatttttacttttgagtatcagctagtgagtagcagggcaaaaacaaggcagccattgatctaagtgtaaggcagcaggaggaaggttaagagaatgagtgttattctttaggactacattcatagttgcatggtgttgctcttggctcaaagtctacaattaaatcagttgttggcactcccttgaaagcattactatcacagtttcccctacatatgtaagtcaataaatttgacctttaagaaggacagttggtgtagaccccctccactgggccaacacatattgcaaatttctgaactcaggccctgcaaagtactactgccaccttgcttctttaacagagaaggcaaaataaacagaggaggattccatggtataaaaaagaaaaaaatacattatttatatttaaataaataaaattatttatagagcattatttatatgtgtcagtctgctgtgggtcaggtactatgttagattcttttatttattattttgtggaatgagatttgtttttatatatgaggaaagaggtttttcataaaagatggagccaagatttaaagctaactcatttcattcattagttatcatatttagtcaacacatcatttattgagtgcctaaaatctgacagcactgggaaacaacagaagatgaggtcactgcaccctaaaggagcatgttctcgttttttcttcttataccactgcaactgacccgtccacatttcctcaccttcatttctgtgtgcattggctggacttccagctgtcagcatctgcaattctttgcttggaagccctttgccacagtaatgacaccaagagcaaccctccatgaccaactggagttggtacgtaagcagcttagttctttcatctctcagatgggatgactctaaggtgtatgttttccactagcacctagaatttcttcagaatccaactccagttgcccacagttgtagctggcttgatcaaacatctatgtcagctgccttcccttttctacctcatgttcccacttccttgtcagctttctttacccccaggtaaactacttgcatttgaagtcttgtctcagggtctgtttctgaggaaatccaaactaagatgaccaccatttagagaatgcttactaagggatagccagaccctaaagactaatgtagatctatctgtttccaaaatctgtgatctttggagcattgcactgtactatggaattcaagcggaaggaatcccatagaatcttacacttaatcttttcttgggtactaaggaaagtggaaatccatccctagacaggatattttgtagttctctctttcggtcttcaccctctcatgggatgggtgtgttttctcttttctccacagaattgactgaaaagtctcattctgcttttatcatcacttcatttctctgaatgaatcaagcatctctgaatgaaatcaagattttctccctcccgtctgagagtaggatccactctcttgttctataggttctcttttgttctataggttaagggttaaggaaaatgtgacccccttgaacagaatagatagagaaaattattcatttggggatctctgaggagagaaattcttttctagaattttatttatattgcttcttttcttactcaacttatactacaacatagactaaaaagaaaagtggatacataactgtttttttaagtccagaatatttgacaatataatgtggtaatggtgtgaagttttacacctaagcaggcaatagaatatgacacagtttccgacctaccctgcccttgaaataacagaataactttttaacactaacatgcgtttccttgaataacttgtacctctgccaaattccacacaagaagcttcttttcttcaggggctgcttccccacaatgtgaatattctttgactcactatgttgtccatttccaatttccttgttttttgcttgagttcactgaagactgacaaacagtagcttcacgtgacagccattagtctgctttaaacctcagcttgatcttgaatggatagaataatgaatagattttgtgtcatataattcatgttgtcagttatatgaaattggcagttaaagagaaactaaatatgcttccagtcctctcttttctaaattcatatttgaatataataatgtgaaaggcattgttccttcttttagttaaagcatttttgtagcagtctgaactgtgaataatagagaaacatatgctctattaaaaaatagaaggtgaggaagataagtgttttactctttgtattaagaattaacaagtggttttaaaaattgagcttgtatgtgtgtgtgagcacagggaggggtatttcatcataatgagggaggccttggcaacttagtgttcgttttaactccattgattgccgaacacattcatgcctgctctagctccagggaggctgtggaacaggaaataagagattcaaaaagcagcacagaagaaaatcatctcctctccttccatctcccaagcagagaaaaatatgctttcttttttgtcaaaattgcttggtttgtcctattatgctgtcatttcagagagattaaaagtatactttttcatacattgcaagtgggaatgtaaaatggtgcagccactttggagaaacagatggccatttcttaaaatattaaacatagagttaccatatcacccaacagttctactctgaagtatatacccagcagaaataaaaacatatatctgtacagagactcatactcaaatgttcatagcctcattgttcacaatttttcataaatagaaaaaatccaaatgcccatcaactgaataaacaaaatgtggtatagccatataatggaatactatttggcaataagaaggaactgagttacaacatgtatgaactttgaaaatattatgctcagtgaaagacaccagacacaaaggaacatatttaactccacatatatgagatacccagaaaaggcaattctaaagggacagaaagtagatgaaagattgcctaaggctatggataggaatagagagtgactataaatgggtacaaggtttctttttgaaataatggaaatgttctgaaactaggtgttctgaaagtagatagttgccaactctgtaaatatagtaaaaatcaatgaatcataaagaaaaacactacttctattctggtaacaaaaattagaagaacaaaaaaagacagaaattatagtaaaccacaaagtaaattattacccaccatgttaaccatttagtattgatttttttttttttgagatggagtttagatcttttgcacaggctggagtgaagtggcacaatcttggctcacagcaacctctgcccctgggttcacgccattctcctgcctcagcctcctgagtagctgggattacaggcacctgccaccatgcctggctaatttttgtatttttagtaaagatggggcttcgccatgttggccagactggtcttgaactcctgacctcagatgatccacctgcctcagcctcccaaagtgctgggattacagatgtgagccactgcactcagccagtattgatttaattaactgaaatttaatatagtagaggaaaataaccaaaatgaagctctaaagcatgtcacagagtcctaattattcaaagaatcataaagatgtgatttacaccattcaataaactgcaaaaaatttgtgcagaatcaaagaaagcaggcacaacaacgtatattcttaattatttcatttatataaatttttaaaaccagtcattggtgaaagaaatcagaccaatcattgcctctgtggttggagactgactagggcacaagggatgatgtgcgctagtgcccttttgatgcatgaaagttgtaaatttctgggatgatggaaatgttctatatcttaatagtgatatgtgctatgtggatatatgcatttgtcaaaaactcattgaactgtttccttaagatctgcacattttactgcacgtaagtcatgccttaaataaaatctgataccttaaataaagtgagagacaggaagaaattggctattggaagcacaaaacaaaattgaaagtttagaaatggacccattagatatataataatttagtataggatgaaagaagaatttttaaaggtttttttagaaacagagtctcactatgttgcccaggctagagtacagaggttattcccaggcacaataatggtacactgcagcctcgaactcttgggctcaagccatcctcctgcctcagcctccgagtagctgggactataggcgtgcgccaccatgtctagcagaaattttaaatcagtgagggcaaaaagggatttttaaataacaatactgggatcaggaaagataaaagctggagtcatttcattcctaacaccaaaattaggtcagatgaataaaagattcagatagaaaaagtgaaataagtttacttcagatatttatgtattgtttggagacttttatagcaaatacattttaaactttttgtggtaaaatatacataacataaaattaaccattttagccatttttaagtatacagttcagtggcatcaagtacattcacattgtgtgcacttacttatcaccaccatccacctccagaacattttcatcttcccaaactgaaactctgtatccattaaaaaccaattctccattccttccagtccctagcccttagcccctggcaaccgccattctactttctgtcttcataaacttgattagtctaggtgcttcatataagtggaatcatacaatatttgttcttttgagactggcctattttacttagcacagtgttttcaagattcattcacattgtagcgtgtgtcagaacttcatttattttaagggtgaataatattccattgtatctgtataccatatgttgtttattcatttatccattgatggatatgtaggttgtttctgccttttagctattgtgaatagtgagctatgtacatttgagtttaagtctttgtatagatatgtttttgtttttgagacagagtttcactcttgtcatccaggctggagtgcaatggcacgatctcagctcactgcaacctccgcctcccaggttcaagcaattctcctgcctcagcctcccaagtaactgggattacaggtgcctgccaccatgccgagctaatttttgtatttttagtagagacaagttttcaccatgttggccaggctggtctcaaactcttgacctcaggtgacccacctgcctcggcctcccagagtgctaggattacaggcgtgagccaccgtgcccagcctagatatatgtttttaataagaacttgtgtgtacagatattttggtgagttccttctttcaattccatggggtctatacctagaagtggcattgaagaatcatatggtaattctaagtttaattttataaagacctaccttactgttttccacagtagctgcaccattttactttcccaccagcaatgtgcaagggttctaatttatacacatccttgcaaacgcttgatattttctatcttaatttttctctaattaattttcttcttttttttttaagagacagggtcttgctccattgtccaggctagagtggtgtcacatgaccatggttcattgtagtcttgacctcctgggctcaagtgatcctcctgcctcagcctccagagtatctgggactacagatgcatgccacaacacctggctattttttttcattttttgtagtgatggggtctcactatgttgcccaggctggtctcgaactcctggctttaagtaatcctcccaaagtgctgggatgagccactgtgcccaataaataatagcattcttaataggtatgatgtggtatctcattttgtgattttgacttgcatttccctaatatttagtgttgctgagtatcttttcttgtgcttattggccatcaatacatcttctttggtgaaatgtctgttccagccctttgttcattttttaaattggaatatttgcttttggttgttgtattgtagttttttatgtatccttgatattaaccccctatcagatgtgtgatttgcaaatattctctcccattctgtggactgcctttttactctgcggatagtgtcttttgatgcatgaaagttttaaatttggataaagcacactactttttcttttgttgtctgtgcttttgatgttagattcgagaaatcattgccaagtccaatgtcatgaaactttcctctatttttttctaagagttttctagttttagctttgacatttaggactttgatctagttttaatttttgtgttcatgtgttttctttatgagatggagttttgctcttgttgctcaggctggagtgcagtggcaccgtctcagctcactgcaacctccgcctcctgggttcaagcaattctcctgcctcagcctcctgagtggctgggattataggcgtcaaccaccacacctgactaatttttgtatttttagtagagacagggtttcaccatattggccacgctggtctcggacttctgacctcagatgatccacccgccttggcctcacaaagtgctgggattacaggtgtgagccactgcacccagcctaattttcttatatggtataaggtaagggtccaactttattatttggtatgtggatatccagttttttcaacacatatttcctactgaatgatcttggcactcttgtagaaaattatttagccatttatagccagagttgatttctggactctctctattctattgtattggtctaaatgtctgtctgtatgccgttataacactgttttgattactgtagctttgtactaagtaaattttgaaacaaggaagtgtgaaacctacacatttgtcttcttaaagtgtttttttcttagtacttggggtcctttaagattccacatgaattttaagataggtttttttatttctgcagtaaatgtcattgggattttgatggagattacattgaatctgtagattgttttggttactattgatatcttaacaatattttcttctaatccataaatgcagagtgcctttcagtttgtgtctgctttctttcagcaatgatttacagttttcatgcatgctttttgcctccttggttaagtttattactaagcattttattctttttgatgctattgtatatggaattttttttatttcttttttgaattgttcattgttagtgtatagaaatgctaatttttgtgtgttgatttcgcatcttgcaacatcactgaatttgtttattaattctaacagctttttttggtggaatctttggaggtttctacatataaaataatgtcaatggagataattttacttcttcctttccagtttggatgacttttatttctttttgttgccaattgctctgactagaactttcagttctatgttgaatacaagtggtaaaagtggatatccttgtcttattcctgatttcagaggaaaagcttttagtttttagccattgagtctgataataggtgtggaattttttatatatgatctctattatgtcacactttaaaaaaatctatgaaagtatcaaaagatggataaatatttacgtatttatacataaatataaataaacatttatatcatttgggggaaaagaatcttaataaccaaagccaaaaattataagggaaagaaaaagatgatagatttaattctgtacaaaattgaaaatatttacctagcaaaaacttcattaattaaaatgatataataaatagggataagatccttaatactgtataaaaagaactcttatatatacataaggaaaaatccacacacaaaagctacattggcaaaggacatgagcatgaaattcacaaaaaagaataaccaagggtcaaagaatatatagaaaaagagtttatcttctctagtgattacaaagaaaaatgaaattagattttttttaacctgtaagactgaaaaagatgaggaagagtgataatattcactcaatgtagtaatttcatatcctttcagtaggaataaaaattggttgagtcttttttggaaggcaccaagtattaactcttgaaaacgtgcatccccagcaactgtagttgtccctcagtatcagtgaggaattggttccatttggtaccctacaggtaccaaaacccatggatgcttaagtctcttatataaaatggtatagtatttgcatataatctacacatatccttttgtacactttactttttattttttaattttttttgagacagagtctcactctgtcagcaggctggagtacagtggtgcaatctcggctcactgcaacctctgactccctggttcaagcgattctcctgcctcagcctcctgagtagatggaattacaggcatgtgtcaccactcctggctaatttttgtatttttagtagagaacaggtttcaccatgttggccaggatggtcttgatctcctgacctcatgatccacctgcctcggcctcccaaagtgttaggattacaggcataagccactgtgcccagcccttttgtatactttacatcatctctagattactcatgatactaatacaatgcacgcacatcacttcatttgcatggattcaacatagtacttgtacacatagtacacacagcaaattcaagttttgcttttcagagatttgtggaatttttttctgaatatttttgatttgaggttggttgaatccatggatgcaggactgatgcacatgacgaacatactgtgtatacctctgggtttatgctaaggaaataattgctcaatagatatgtacaagtatgtttagctatatatctaaaagagcaaaaacttcgaaaaatctatcaactatgtctatcaactatggggccactgaaaataatgatgcagattatcgatttatagatatacatgtcatatggtttgtttcatgcgcgtccgtgtaaagagaccaccaaataggctttgggtgagcaataaagcttttaatcacctgggtgcaggcgggctgagtccgaaaagagagtcagcaaagggtggtggattatcattagttcttataggttttgggataggcggtgaagttaagagcagtgttttgcaggcaggggtggatctcacaaagtacattctcaagggtggggagaattacaaagaaccttcttaagggtggcggagattacaaagtacattgatcagttagggtggggcagaaacaaatcacaatggtggaatgtcatcagttaaggctatttttacttcttttgtggatcttcaggtacttcaggccatctgggtgtatacgtgcaaatcacaggggatgcgatggcttggcttgggctcagaggcctgacagtttggatctgtgtccccaccaagtttcatgtcaaattgtattctccactgttggaagtggagggaggtggttagatcacaggaatggatttctcatgaatggtttagcaccattaccttggtgctgttctcatgatagcgagtgagtgagctctcgtgagatctggttgtttaaaagtgtgcagcacctcctccctcactctctccttctcctgctccttccatgtaagatgcctcattccccctttgctttccaccatgattagaagcttcctgaggcctctgcagaagtaaaagctgctatgcttcctgtacagcctgcagaaccgtgagtcaactaaacctcttttctttataatttttttttttttttgagatggagtctcgctctgtctccaggctggagagcagtggcactatctcgactcactgaaacctctgcctcctgggttcaagcgattctcctgcctcagcctcccgagtagctgggattacaggcacgcaccaccacgcccagctaatttttgtagttttagtagagacggggtttcaccatgttggccaggatggcctcgatctcctgacctcaggatctgcccgccttggcctcccaaagtgctaggataacaggcgtgagccaccgagcctggcttttcttttctttttttttttttttgagagggagtctcactctgtcgcccatgctggagtgcagtggcctgatctcggctcactgcaagctccgcctcccaggttcacgccattctcctgcctcggcctcccaaagtgctgggattacaggtgcccaccaccgtgtctggccattttttgaatttttagtagagacagggtttcatgtgttagccaggatggtctcaatctcctgacctcatgatccgcctgcctgggcctccccaggtgctgggattacaggcatgagtcaccacgcctggctgcacccggcttttctttataagttactcagtctctgacatttcttcatagcagtgcaagaacggactaatacaacatggaaagatattatatattcatattcatatatttttgagtaagagaagtaggttgccaagtaacatgcctagtacaatcccagttttatttacttacatgtttaaatatttatttttgacaaaatttgggagaatatgtatataaaagtattaaaactgattgtgtctttgtagtgggattttaagtgattcatattttcctcttttgtatctttttctgaagtctctacaatgaacatgtaatcttgttagagtaatggttttgttaaatgataatattactttttcagtagcgttgagtacattgttgtgcaaccatcaccactatctggttccggaactttttcatcttcccatactgaaactctgcactcattaaacagtaattcccctttgcccctcctctagtgataatagctttaaatcaagaaaattctacatttaataattttattttttcccccttcccaactacacatatacttttaagaaaagaacagttttattgagatataaatcaaatgccatacaattatcctgtcacacacatactttggaagttctgtgaccctctttgtagtttgtttgtttgtttgatggaagcatttttaccaggcagaaagtacaacgttggaagtgaatgttcttgaatttattggagacaaattatagaggaataatgatatgtgaattttacctaccataaacctgcatcctgtatttggacaggagctctgtgtaccttcaaaaactgttcaaaactggttttaggtccagctccctgtgaaagttgagttaagctaaagagcaggaatctattaacaggtcaacagcagcaggggggcggggattggaaagggcctggagcagctgcggttcatttgggagtttaaaattggcttttcttttattctcttattcctgctacctccatagaatccaggaagaatagggatgttttttcctacatttgattataacaggcccaaatctctttgaacataaccagtaaaggaaagaagcatccgtggccatcaaactgggtaaaatggtaacataatctctgatgtgtagtttgaatcctattaattataattgtgtagaattgtacagtgagaatgctttgggagtttttaacgctaggtttttcaaagactacattcctcattagaccttccccattaaggcatgcttgagtgatgctacacagccgaatagttgggattttttccccctcttgtcatagtctgaagacaaaggattcttccgcttgccaaagttccagggagcctaggttgagccgctgtgacagcacttcggcagggagctttttattcagtcttcgatttgccgtcaggcctcattcacgaaacaggatcaagttggagcagtacacggagaaaaaaaaatcaacagaggaaaatctcgcacagccagatatggcgccatgggtcactttttcctttcactaatgctgagtcatgatgcagtctaggctaaggcacagaaaactgtacatttctggtcctaactgcattgttgtccctcaggattctcggtgcctttgctaaagtaatgttacaacagtccagaaaatgctagcattagtattgcagcttacttgacttctctgagaagcagcgagagtggcacaaaagagctgggagccctgcagttgataccaaaataacctgccaatggccttacaaccttgctacttctcagtttttcctagcctcagtttcctcgtctacaaagtatggataatgtgctgctgcttcttatttacaaggttcttgtgaggatcaaacagaggtaatgcatatgaaaatgtttgttacattacccaggaatgattcttattatcatcagaatttttatatttgaatttagaagttgtatgtatgtgatcgcttctggattatgtgtgtgtgaacttcacacattatcaaaagagattacttttttaatattgtttgcccaagggaaagtgttgagggctacataagtttaaaaatgactttaacttaggcattagatataaaatggtctccccatttgccttcaattcagtaaaaacagcatatttgtgattggctacatcaacaggcatccttccctcttatgtataatctggtatagcatagtgattaaaagcacaagctgtagagccagatgcacaaacacaacatttttgtgttgacaaaagacaaagacactaccaccgttgcgacctttatgtatcttactatctaaggtttttaaatccatattacatctttacaccatcggttgtttattagtttattagagctggcaaaacaaaatgccgcagactgggtagcttaaacaacagaatatttttttcacagttctggaggctagaagtccaggatcaaggtgtgagcaggtttggtttctcctgaggactttgtcctaagtttgcagaggctgccttcttactgtatcctagcaggtctttcctctgtgcccccacatctctggtgtctctctgtatatccaaatttcctcttagaagaggccactagtggtagctcacacctgtaatcccagcaccttgggaggctgaggctggtggatagttttaagtccaggagtcaagaccagcctgggtaacacagtgaaagcccgtatctacaaaaaaaaaaaaaaaaattagccaggcatggtagtatgcccctgtagtcccagttacttgagagctgaggtaggagaatcacctgattctgggaagtcaaggcagtagtgagccataatcacaccaccactgcactccagcctgggtgttggagtgagaccctgtttcgaaaaaatacaaataaaaaaaatttaaaaaaaaaaagaagaaaaagcaattagattgtattagggcacatcataatggctttattttaacttaatcacctctttaaaagccctatctctaaaaagtcacatctgagacactgggatttagggcttcaacataggaattttgggagaacatagttcaacccctaacataatgctctctactccacagataatgcaaaattagccaagggaccaggattgactctagtatcatacaaaagagtcaaaggcaattgtgagtctagtagtaaaatttatttgaatatctcatgtggtactcacatcaatcatataaaagacatctgacttttatggagaaactcagactttcatggaaaatcatagatatttggcaataatttttggcttagtccataaagagtttggaaattagaatttggggttgtgtcagaatacggaaacagaattcacactagttgtttcagcagaggaaatttaatacagagaataagtataaagatatttactactacctgcttaccagatgcaattttgcatgatattctaaatgaagcagacacatgatagtttgtggcatgtcaagatgatcaagaatatgacagtgcaggagttgacatagttctgagacagcagtgtgaaggtatgctgttgtcctcattaggtgaaagcaaaaggcttatggtaattcttgagaattttttgaaggggaaaaaaatgttaagatcaatagctaagtactacatgcgagatacttgtattgctttgctcaagttatcacatctggaacagcagttgcaattggcattacttgattaagtttacaaaaatccatattcactgtccaagatgaataaatctgcacaggccaaattaaatgggaatgttaggaatcacacctgtatcttttaagtctttggtggtggcattaatcttgacagttcttccaagggtgtgataattgcttttagtttaccattaggataggacaaaaggagttccaagggcttccacttggccctcctacagtattagctctttctctacatcccagtgtggaaattagatcatttttaaagcatgttggctgggcacagtggctcacacctgtaatctcagcaccttgggaggcgaagatgggcagatcacttgaggtcagaagttcaagaccagcctggccaacatggtgaaaccctgtctctactaaacatacaaaaatgcacacctgtagtcccagctacttgggaggctgaggtaggagaatcgcttgaacccaggaggcagaggttggagtgagctgagatcatgctgctgcactctagcctgggtgacagagtgagactcagtctcaaaaaaaaaagcatgtctacatatagtctacatatatgatacattaaaactatagaaataactatagggtagatcctataagatagacgagcccaaacttcatttaccacttgatatggtttggatttgtgtccccacccaaatctcatgttgaagtgtaatccccaatattgggggagggactggttatgggtgactggattatgggggtggattttccccttgctgttctcatgatagtgagtgagtgctcatgagatctggttgtttgaaagtgtagcacttccttctttgttctctctctccctctccctctccctctctctctccctctccctctccctctccctctccctttccctctccatctccatctccctctccctctccctctctccctctcctgctctgccatggtaagacatgcttgcttcccttttgccttccaccatgattttaaatttcctgaggccgcccagccatgcttcccatgtagcctgtggaactgtggatcaatttaacctcttcttttcataaactacccagactcaggtagttctttatagcagtgcgagaatggactaatatggaaaattggtagagaaggggggcattgctataaagatgcctgaaagtgtggcatcgtctttggaacttggtaatgggcataggatggaacagtttttagggctcaaaagatagtaagatgagagaaagtttggaacttcctagagacttagtgaatggttttgaccaaaatgctgatagtgatatgtgatatggacaatgaagtccaggctgaggaggtctcagatggaaatgagcaacttattgggaactgaagtaaaggtcactcttgtgatgctttagcaaagaggctggtggcattgtgcccctgctctagagatctgtggaactcttaacttgagagaaatgatttagggtatctggtgaagaaatttctaagcagcaaagcattcaggaagtggcctggctgcttctaacagcttaggctcatatgtgttcacagagatggtctgaaattagaacttatatttaaaatggaaacagagcataaaagattggaaaatttgcaacctgatcatgtggtagaaaagaaaaacccattttctgggaaggaattcaagccagctatggaaatttgcataagtaaggaggagcccaatgttaatagccaagacaatggggaaaatgtctccaagacatttgagagacctttgtatcagcccttcttatcacaggcctagagtcctagaaggagaaaatggtttcatgggccaggtccaaagccccactgctctttgaagccttgggacctggcaccttgcactgtggctgctccagctccagccaaggctaaatggggtcagggtacagctcaggccattatttcagagactgcaagtcccaaaccttggcagtttctacatggtgtttggcctgtgggtgcacagagggcaagtgttaatgcttgaaagcttctacctagagttcagagtgtgtatggaaattcctggatgtccaggtagacgtctgctgcaggggcggagcccttatggagaatctctactagggcagtgcagaagggaaatgcggcatcagagtccccacacagagtcctcacttgtgcactgcccagcagagctgtgagaagaaagtcactgtcctccatacctcagaatggtagatccactaacagcctgcactgtgcacccggaaatgccacagtcactcaacaccagcctgtgaaagcagctgtgggggccataacctgcagagccacaggggtggagccacctaaggccttgagagttcacctcttgcatcagcatgacttggatgtgatacatggagtcaaaggagattattttggggctttaagatttaatgactgccctgctgggtttcgcacttgcatgggacctgtagcttctttgttttggccaatttctccaatttggaaagggagcatttacccaatgcctgtaccccattgtatcttggaagtaactaattttttttttttaattttataggctcataggcagaagggacttcctagtctcagatgagactttggacttggacttttgagttaatgctggaatgagttaaaactcggggggactgttgggaaggcataattatgttttagtgtgagaaggacatgagattttggagggggcagggtggaatgatattgtttggatttgtgtccccacccaaatctcatgtcctattgtaatccccaatgttgggggatgaacctgatgggaggtgattggatcatgggggtggatttctcccttgctattctcatgatagtgagtgaattctcatgagatctggttgtttgaaagtgtgtagcacttccctctttaccttctctctctctcctgcaccaccatggtaagatgtgcttgcttccccttcaccttttgccatgattgtaagtttcctaaggccttccagctgtgcttcctgtagagcctgcaggactgtaagtcaattaaacctcttcataaattacccaatctcaggtagttctttatagcagtgtgaaaatggactaatacatcacctgaacaccataaatgttctctttggctactgatccccagtggtgttttgagtgcctgaactagcattcattcacaaccattatatagaattcttcaaggatatatagaatctttaatttctctcaataaaaaggtcaaacttcacttgaatcatattagcaagtttaatccacattatttgtttatctggagagctagcatatgtctacatatgtatgtatgcatacctatttattccaaaactgatttaaagtgtgcacttatctaagaagttgtagtagccaaggtggtacactgctcagatgttacttcaggagaaactgcttcaaggaacataattgtcagacagtttccagctgttacacctttggatctgctgcagtgtttatgccaaggccatgctcaccccaggctgctactagccaatagctgaacatattggggtatgaaagccatgccattctgcctgatgcctcttacagtaggcaatctttgctccaggacttcccatcagcctggccaagactttctcagaatcacactgcaggccgaagctccttttcctcagtcctcctgccttccctcctggctttctctctcccctttcacaggtgtcagatccacattgtgttcaaagagctctcttctcctatttctgatacctcacttgtttatcctctgtaggtgtttctcctaatacatctcttgcacatctggttccaccttggcatctgtatctttgaggacctaaacagacacagaaatcaagtaacaatgcaaaaagcctgacgctcactgactattagattgttgacaaatataagattgctgggccttgggaaagcataatttcacttgttcctaataactgaaaatgctttttgaaaaactaaatatgccatgcataaagggcctaagatttaggttttcctgtagaaaaacatctgtgccctagtgggaaagtatcacttttaaatataaaattttaaaatgaatccagggaagacattaaattcccaggattgaggacaataaccaagaacctgaacagcatttacgtgtttgttggtctctgctttctttatcttgccctctttgcttcctgctttatgttataaagtgttaatgtgtcaaaaatgaaaaatgtagggttggtgtgatgttctcaacaggcttcttgaaaaatatttttttcatctttcaagaatcagctaaaattgaatttggcattgtttgccctttgttgcctaggcattggggtcagactcttgtctgacctaagtgaagccatgatggacagttctgtagagggcattatcacagcctaatcagataaactgaaagcaaaattgtttttctctctcccacagaatctgctcctccattttcttcctcttttatattcttttctaacttgccctgtgaattttcaagacatagtaagattttattgttattactgagatagattggttgcagaaactgttgtatgaaccaaatgtcttctgccttgtagatagacttcctcaggaactaagagcagtgtctgtacgcctcaggtaacaagtcactgccaactctgtaatacgttttaacctgatgcagaagtaggggccctgctgttttctggattctttagccttttgttcaatgtaataatgcatttaatcatgggagaatttaaaacatttaccttgtaatagtagcaataagtctaagtcccaaatcaatagaaacctggcaaaaaatactcagactaaacaaaattaccaagaacaacgacaaaaaccaaatcctaagagccataaaggaatcccttttttgtacatgtttaattttacattttagcaaaaataaaaaataaggaagcaataagtttaggtttgggctgaagatgcaatgaaaatataggcttatgagaaagtaaaatactaataaaatagtattttgcttctctgctgggggagtaagtgaaggaaactaatatttcttgcatttatgctatgtgccaacccttgtgctggatgctttttatatatattatcttggccctccccagaacccagaaaagttttttttttttttctagacagggtctcactctgtcacccaggccggagtgtggtgactcaatcacgactcactgcagcctcaaccctctgggctcaagtgatcctcccacctcagcctcccgagtagctgggatttcaggtacatgttatcagacccagctaatttttttaaaaatttttggtagagatggggtttcaccatgttgcccaggctgctcttgaactcctgggctcaagccatctgcctgcctctgcttcctaaagtgctgagattacaggcacgagccaccatagccagctcccatgtcatcattttgtcagtgagtaaactgaggcttagataagtgaaataagctgcctgaaatcgcatgcgtttgtggtccctctgggattcaaacccagtcctgtctgactttaagttgtggataaagaatgattttggaactgtgaaggctaagcaaatactggtgagagggactaactcacacatgagacagctaaataatgaagtacatacagtctagagcaagcaaagacccaggctagtggtaatcactccctatgtattttgccagtcctaaccagagtctgagagccccttacaagtgaagtcactgcaactgcaattggtgatctttcaggaactaagtgaggaaaaggaggaagcatggaaagacttgagatgaagataagtagtcccaactttcacaaacccgggtataacttcaataatttctgttgcctttgagacatgttgagccctcagttgcctgggcttgagggaagttagtaccagaactcagagaaaggacttggttataaggctgattccaaggagtgcataaaactttctaatatctgatactggaaatgggaatgaagagttcagtcttgatttaaactagctccattattctaggaggtgggacataaggaaatatagacagcagatgacatttgaattaacataaggggcatagaatggcaagcagcctgttgggagccagaccagttaagagttaaaagacaagattcagcccactgggaaagtgtgctgttaactacaagtcagagtaataggacttcatcagaagggctggaactaatttttgcctatcctcttgaccaagatttgacaagagtgacggaagaggaaacattctacatataggggacattcctacatattgctagtagaaatgtaaattaatacagtacctacagagagagtatcttggcagtatctgttggaattacaaattcacattttctttaacccaacaagaccacttttaggttttgaacttgtagaaatactcaatgtacacagtcatgtatatacaaagacatttctgcaggattcttgaaaagggcaaacaaattatagaattccttgtctcttgactaggatttttgtataggttttataattccctcttagggctttcagtagttaccacttagctattatttttataataaatgagtttatttttaaattattatgttaattcataattattatgataattaaagccaaaattgtattatatataaatatatatacatatatctaaatatttacacattagtttaagcaagattatgttgttaaagctattttcagtttaatgtgatacagtgttttgtttgttaatagtgattcagttaaggcagatagccatatcaaaagcatttgatggcctggcgcggtagctcacacctgtaattccagcactttgggaggccaaggcaggtggatcaccagaggtcaggagtttgataccagcctggccaacacggtgaaaccccatctctactaaaaatacaaaaaaaaattagccaggcgtggtggcaggcgactgtagtcccagctactcgggaggctgaaacaggagaatggcatgaacctgggaggtgcagcttgcagtgagctgagatggtgccactgcactccagcctgggtgacagagcgagattccatctccaaaaaaaaaaaaaaaaaattagccggacatggtggtgtacacttgtaattccagctactcgggaggccgaggcaggagaattacttgaacctgggaggcggaattgcagtgaaccaagatcacaccactgcactccagcctaggccacagagtgagactccatctcaaaaaaaaaagagcatttaataagcatttcaatttttaaaattaaggaaattttggttttgactataggtcctagtcaagtctttccagaactgatatggccaacctctgttgagcaatgtggatgttagaagatggggagccagtgagggactgcaggttaagggatgtgtagtaagctgttaggagcaaggccacctaagtccccccacttaaattcccagtcgtttcatttcctgttttttctttttgtccccaattgtctttttttttttgagacagagtctcactgtgttgtgcaggctggagtacagtggcgcaatctcagctcactgcaacctctgcctcccaggttcaagcaattctcctgcctcagcctcctgagtagctgggacgtcaggtgcatgctgccacacccagctaattttttgtattttagtagagaccgggtttcaccgggttgcccaggctggtcacaaactcctgagctcaggcagtcgacctgccttggcctcccaaagtgctgggattacaggcgtgagccaccaggcccagctcccagtgtcttaatgtagtactctaggtggatgagaggattggggtcaggaaaaaagtctggtaagtcaaagaatagagctgggtttgatttgaaaagacaagataatggacagtttttaagagatagagctttataggaaggaagattgagatttaagacgaaatatgtcaagaatgggtcagttaagttctacctggtatatcagatctccttctttaaagcttcactcttcattgacatacacagacagatttaaacaatttaaacaaaaattatagctaactcttaagtacttaatatatgcccaagcttaatgctttatatgcattaactcactgatttcttacacctctatgaagtaggtcctattataatccccatttaacataaagttgaggaaagaggcctatacactaagtgatttgaccccagacccatagctattcactatactgtgtctctctgtctacctcatagggtttctgtgagaatcaagtgagttttgtgtgtgaaagtactttgaaaaccacaaagcatttgatacttgaaaaccagttctcaagagatagaaaatgttattcactctactctgtggaacaattctttaaaaacaggacttggaaagcaagctactgtcaaaactaaaataaaattaacctcaaattagaggagcacttttagatgacaaaataagtactaagaaaatacaacaataaaaagaaaaaatgacatacaatcaagatacaagactaattgtaatttttaaaatggccttttttgatggggtgagagtttttcacagagctgaaagctgtgattgcattgccacattttacaaaacagtctctggaacaggattgacctggctatcaaaggataattacatggcctaatagattgtccctaccttcaactgctaatgaagcccttggaaaatgtatcccccacttaacgaatgaggctgaaaatgccaagaagccttttgccaaggatgtgttctctaggctcaggctgaattcattattttgttagagtattaccaccaagccaaccatgggcaatttagcatgccacatttcaagcagaatttaattcatctctgtgtgccataaatgagacaaataccctgtgatcaggtgacagctgtcagtaatgccataaacagaaagtattaatgtaagtggtgaattcctcttaatcatacccccattaaaagctggtacaaaaattagggggtgtgtgtgtgtgagagagagagattgtgaggaaaggcatgcataaaatagtctgattactttacgatactcaactccacttttgttataaaacctcacttattttcataccaaaaaacaacaggtaaatttcttgatgaaagaaagtacctctgagttaccctttgtctgaaaatgtatgtctttttatggaattgcctagctctgaagatagctattgcttataaagactagtttgttcttcctttctttctttttttttttttttgagatggagtctcactctgtcgcccaggctggagtgcagtggcgtgatcttggctcactacaacctttgcctcccgacttcaagtgattctcctgcctcagcctcctgagtagctgggactacaggtgcacaccaccacgcctggctaattttttgatttttagtagagatgggttttcaccatgttagccaggatggtctcgatctcctgaccttgtgatccacccaccttggcctcccaaagtgctgggattacaggcatgagccaccgcgcccagccagtttgttctttctttaagaccacatgctttccttaatgtagcaaatctaaaagcagggacatttggaatgttactcaaagtgggagggagtcctaccacccagggagcctgacatcccagtcagaaagtgacatatgaatgtattaagaatgggcccaacatctaacaataaaaaaaatgggttaccttaaacaccattttttgaacacttactgctcccaggctctgaacatctgaagaaacatctgagagacaccaaggatgcagtgagaatcttttttctcattagatgtaagagcagctctcagttcttttgggcatcagagttacctaggaagagttgggggttgtattttgcagtctctggagtcagactacctggttttacatcctgtctctgctgtttgttagttgtatgatcaagggtgttacttaccctcagtaagtctagtgcttctgtttgtaaaaatgaaagggggaatagataaaaatagatctatcttattaagtaaagatggactgatataatgcctggtgcagtttcaggcatatggtgagcatgcaataaataaatactagctcatttattattagtagtagaattatgtttcttctcctacccagagtgagacattaattgatcaaaatgtgtcatacacctcatgtggattggggcaaaacaaaaaccaaaagagaaacacagttttgtgcaataatttaaatctcttaaataaaaaatgtagagaagttgctgttagtaaaatgtactgacttttcattctttattaattcaatgatatttgttatcaaatattataataaatgctgtttgagcccaagtataaatctgatttgtgacttgccttcaagaaccacagtcttgtcatggagaggagaggatgttatgattgggaagcagtggtggggcactagaaggggtgggtcttctggagatctgacaaaattccatttcttgacctgggtggcagttctataataataaagttatgcatctatattatatgtactttttggtgtatatgttatagtcacagtaaaaatgtctttaattgtggtatgtgagtgatttgtatctcagtttaaaaaaattatatgggatattcctgaataaaccttggggaatgtttctttctttcttttttttttttgtgataagagtctccctctgtcgcccacgctggagtgcagtggcgtgatctcagctcactgcaacctccgtgtcctgggttcaagcgattattctgcctcagcctcccaagtagctgggactacagacatgtgccgccatgtccagctaatttttgtatttttagtagagacggagtttcaccatattggccagactggtctcaaactcctgaccttgtgatccgcccaccgcggcttcccaaagtgttgggattacaggtgtgagccaccacggccggccaggaatgtttcttagacaaagcatcaaaagcacaagcaaccagcatatgttaattagcttgatttagccattctgcaatgtatacatattgaaagcaacaagttgtacaatatatacgatttttatttatcagtaagaaaaaaagcacaagcaatcaaagttaaaatagacaaattggactttattaaaattaaagacttgtgcttcaaaggatactattgagaaagtaaaaatataacctatagaatgcaagaaaatatttgtaaattttctatctgataagagtctggtatctagactatatgaagaattattatgactcaacaatgacaaggctgggtgtggtggctcatgcctttaatcccagtgctttgggagactgagatggaaagattgcttgaggccaggagtttgagaccagcctgggcaacatagtgagaccccatctctatgaaaaattttaaaaattagctggacatggtggcatgtacctgtagtcctaactactctggaagctgaggtgagaggattgcttaagcccagcagtttaaagttgcagtgagctatgattatgccactgcactccagcctgggcaacagagcaagactctgtctcaaaaaaagaaaaaaaagaagacaaccccattttaaaatgggcaagaggtttgaacagatatttttccaaaaaagatatataaatggtcaataagcacatgaaaagatgctcaatatcattaatcaccagggaaatgcaaatcaaaaatacaatgaagtatcactttataccctctaggatggctgtactcaaaaggacagacaataaaaagtgttggccaggatgtgaagaaattaaaactctcacacattgctggtgtgaatgtaaaatggtatagttgctttggaaaacgactggctatttcctcaaaaagttaaacatagaattaccatgtgtcctagcaattccatttctatccaggaaaaattaaaacataagtccacacaaaaaacttgtacatgaatgtttatagcaataacaaaaaagtagaaaaaaaattttcatcaactgatggaaaaataaaatatggtgtactcattgatgaaatattattcagtcatataaaagaatgaagtactgattcatgctacagcacagaggaacattaaaacgttatgctatgtgaaagaagccataaaggccacacattgtataattccatttataagaaatgttcagaataagcaaatccataaacacagagagagtattagtggttgtcagggactatgggggaggatggatgggagagtgactactagagggtacaggacttaattttagtgtaataaaaaatgttatgaaattagatagtggtaagattgtaagactgaatatgttaaaaaccactgacttgtgtactctaaaaagctgaatattctggtaagtgaattattatctcaataaaataaataaaatacaaagtatgggatagttccatgctttgtaatggttatatttgactaaattatagattgtacaaagagagtaatgggaaataaattttaaaatataaattgaaatcaaattataaaaggctttattagtgagaagctgtcagtagagaaccattaaagatttctgaggccaggcatggtggctcacacctgtaatcccagcactttgggaggctgaggcaggtggatcaactgaggttgggagtttaagaccagtctggtcaacatggtaaaacccatctctactaaaaatacaaaaaacaacaacaacaaaaagccagacgtggtgatacatgcctgtaatcccagctacttgagaggctgaggcaggagaattgcttgaacctgggaggtggaggttgcagtgagctgagatcgcgccactgcactcctgcctgggtgacagagtgagactctggctcaaaaaaaaaaaaattttttttttgagaaagtgaggaatgtgattagagcgtggttcaagaaatttagtctagcatcattttgattcatctctgcgtctttcctagcctttgtactagagaggacagtgattatgtactttgtagcttagttttgtcttagggaatacatatgattttagaaatttttcaaaggactggatcatattagcctggtaaattgaattatatgtcgttttgtaataatacaatgtatatgaatatatacaagcattacctcatttcataggaaagaggtgatagataaaatgagaaaaagcgagattttggttgtgtttactaatacatatttctgatttggagaactgggaagggaaaacataactgtattagtctaagtctcaatgggttgctatattagaataattcactaagggttgtcaaggactgtgaaggatctgagaattgaccttaccagcaagctaacaaattaacctgccatagtttcatgaatgctggcagaagacacaagacttttgggtcagagataaaggacttttgcattttatcatagttgatttcaactttagttagtggaagagttaactagttacacaatttttagaaatgtaatcaaattagtacttgaaagctccaatatatttattgtaaaataaaatattcaatgcagaagttgcataaaacctgtttctcacattgctttttgaatacatgcttaagggacatttaagagtctatggcaaatgttggctctttggattgaaaaccacaagctaaaaaagaatattaaggaaatccaaagcaaatcacttgatttataccaagcactcaattttctcaacacagttcttcagaagacagtttcagtaaattgtgttaaccacagattcattgtttacaatagctttcattaatgtaacattccacagtagggaaaaaaattttacaatgagtgagaaaacactctgtaattaattctcctagtgttttctacaatattccaagagatctgtgtggatcacaaaacaatactgttttttaaaaaaattctgttctagaaatcacatgaaacaatcctacctgtaactgcaattgtattttattttatttaaatctgatgaactgcatgggcatacaacacaatgtgagggcaattgtgccagcagaatatgtctatgatcaggcagtatgctgagaaccagcaggtgggggaaaatgagacttgggggactacagggaatgaatctggaggcagcagcaattttttagaataatttgaaaaccctttgttttgaaggatttggttacctaattaggttagagaagcttgtgtgctttgtacacaaggagagatgatctctatgcttttcctagactctcaaagccatttgtgttaattatatgacctccactaagcactcaaggtctggcctatgatatgttttctgtactcttccaaatgctcatacattcattattaagaaacttggcttcagagcatcagattactgcatttcttgtaaaccagcttagtggcaacaaaatccaattcatctctagacattgggttttcttagatgagctcttctatttttctgtcccttggttaaagaagagctgcaaataggtctgcagagctacttggttatcagttttacttactatcaaaagatctgactgtataacctttgttcttagatatttgctgtgtgtaatttattttattttttggttactaaaacattttcctttttcttaagcagaaatagcacatgactaagaattagaatatgcagtctctcctttcatctcttaatccctcacatataacctgatgcattaagataatgcttttgggaatgtgctatgggtttcaacaacatgtgtgactgctaatgagctgggataggcttggctatgatttctctaaggctggagttcctacgagtgtggagaaatacatattaaaggattaaagatataagagaatgttcatgaactatatcttaactagttcttgtttttaatttatttattttttgagacagagtctcactctgttgcccaggctggagtgcagcggcctcatctcggctcactgcaagctctgcctcctgggttcacgccattctcctgcctcagcctcccaagtagctgggactacaggtgcccaccaccacgcccggctaatttttaatatttttagtagagatggggtttcaccgtgttagccaggatggtctcgatcttctgacctcgtgatccaccccccactcggcctcccaaagtgctaggattatgggcgtgagccaccacacccggcctatcttaactagttcttatggctgaaataagacagagagactgggaacatttcctaaccaaaataggatttggttaaactttgtatgcggtaagaggaaaggacagaccctcttagaaaactcagaccattgccccttgcctcaagactgcacataacataatcctctttctgtttttgcctgaattgcccagatgctcaaagccattcataatgttcacagtgactatattaatttttaaattttggaattattctcatgattttttatcatatatacatatatattgtttgtataggtggtatatgtgtgtgcatatatatagaaaatatatacatttacctataattgcttttggaaacaagtgagatatcaagaacatgttaaagaacagatgatgtgattttgtggctggcaagatggccgaataggaacagctctggtctgcagctcccagtgagatcaacgcagaaggcaggtcatttctgcatttccagctgaggtacccagctcatctcattgggactggttagacagtgggtgcagcccatggagggtgagcagaagcagggtggggcatcgcctcacctgggaagtgcaaggggttggggaactccctcccctagccaagggaagtcatgagggactgtgctgtgaggaatggtgcattctggcccagacattatgcttttcccatggtctttgcaacccacagaccaggagactctcttgggtgcctacaccaccagggccctgggtttcaagcacaaaactgggcggttgtttgggcagacaccgagctagctacaggagtttatttttcataccccagtggtgcctagaatgccagcaagacagaattgttcactcccctggaaagggggctgaagccagggagccaagtagtctagttcagcagatcccacccccatggagcccagcaagctaagatccactggcttgaaattctcgctgctagcatagcagtctgagctccacctgggacactcaagtttggtggggggaggggcatccgccattaccaaggcttgagtaggcagttttcccctcacagtgtaaacaaagccactgggaagttcaaactgggcagagcccactgcagcttcacaaaaccactgtagccagactgcctctctagattctgcctctctaggcaggacatttctgaaagaaaggcagaagccccaggcaggggttgataaataaaactcccatctccctgggacagagcacctgggggaaggggcagctatgggtgcagcttcagcaagcttaaacattcctgcttgccagctctgaagagagcagcagatctcccagcacggtgctcgagctatgctaagggacagactgcctcctcaagtgggttcatgacccccttgcctcctgactgggagacacctcccagtaggggatgacagacacctcatataggagagctccggctggcatctgacaggtgcccctctgggatgaagcttccagaggaaggaacaggcagcaatatttgctgttctgcagactctgctggtgatacccaggcaaacagggtcttgagtggaccttcagcaaactctagcagacctgcagcagaggggccggactgttagaaggaaaactaataaacagaaaggagtaacatcaacatcaacaaaaaggatgtccactcagaaaccccatctgaaggtcaccaacatcaaagaccaaaggtagataaatccacgaagatgagaaaaaaacagctcgaaaaggctgaaaattccaaaaaccagaacgcctcttcttctccaaaggatcacaactcctcgccaacaagggaacaaaactggatggagaatgagtttgacaaattgacagaagtagggtacagaaggtatgtaataaactcctctgagctaaaggagcatgtcctaacccaatgcaaggaggctaagaaccttgaaaaaaggttagaggaattgctaactagaacacccagtttagagaagaacataaatgacctgatggagctgaaaaacacagcacaagaatgttgtgaagcatatacacaagtatcaatagctgaatccatcaagcagaagaaaggatatcagagactgaagatcagcttaatgaaataaagcatgaagacaagattagagaaaaaagaatgaaaaggaatgaacaaaacctccaaaaaataggggactatgtggaaagaccaaacctacatttgattggtgtacctgaaagtgacgaggagatggaatcaagttggaaaacactcttcaggatattatccaggagaacttccccaacctagcaagacaggccaacattcaaattcaggaaatacagagaataccataaagatactcctcaagaagaacaaccccaagacacataatcatcagattcaccaaggttgaaatgaaggaaaatacgttaagggcagccagaaagaaaggtcgggttacccacaaaggagagcccatcaggctaacagtggatctctctgcagagaccctacaagccagaagagagtgggagccaatattcaacattcttaaaagaattttcaacccagaatttcatatccagccaaactaagcttcacaagctaaggagaaataaaatcctttacagacgagcaactgctgagagattttgtcaccaccaggcctaccttacaagagcttctgaaggaagcactaaatatggaaaggaaaacccagtaccagccactgcaaaaacataccaaattgtaaaggccgttgacactatgaagaaactgcatcaactaacaggcaaaataaccagatagcatcatactgacaggatcaaattcacacataacaatattaaccttaaatgtaaatgggctaaatgccccttaatagaccgattaaaagacacagactggcaaattggataaagagtcaagacccatcggtgtgctgtattcaggagacccatctcatgtgcaaagacacacataagctcaaaataaagagatggaggaagatttaccaagcaaatggaaagcaaaaaaggaaaagcaggggttgcaatcctagtctctgataaaacagacttcaaaccaacaaagatcaaaaaagacaaaggcattacataatggtaaagggatcaatgcaacaagaagagctaactatcctaaatacatatgcacccaatacaggagcacccagattcataaagcaagttcttagagacctacgaagagacttagactcacacacaataatagtgggagactttaacaccccactgtcaatattagatcagtgagacagaaaattaacaaggatattcaggacttgaactcagctctggagcaagctgacctaatagacatctacagaactctccatcccaaatcaacagaatatacattcttctcgcaccacatcacacttactctaaaattacctacataattggaagtaaaacactcctcagcaaatgcaaaagaacggaaatcataacaaacaatctctcagaccatagtgcaatcaaactagaactcaggattaagaaactcactcaaaaccgaacagctacatggaaactgaacaacctgctcctgaatgactactgggtaaatacgaaattaaggtagaaataatgaagttctttgaaaccaatgagaacaaagatacaatgtaccagaatctctgggacacagctaaagccgtgtttagagggaaatttatagcactaaatgcccacaaaagaaagcaggaaagatttaagatagacaccctaacatcacaattaaaggaactagagaagcaagagcaaacaaattcaaaagctagcagaagacaagaaataactaagatcatagcagaactgaaggagatagagatacgaaaaacccttcaaaaaatcaattaatccagaagctggttttttgaaaacattaacaaaatagactgctagccagactaataaagaagaaaagagggaagcatcaaatagatacaataaaaaatgataaaggggatatcaccagtgatcccacagaaatgcaaactaccatcagaaaatactataaacacctctacacaaataaactagaaaatctaaaagaaatggataaattcctggacacatacaccctcccaagactaaaccaggaagaagttgaatcccttaatagaccagtaacaagttctgaaattgaggcaataattaatagcctgccaaccaggtaggctattaaaaaaaaaaaagcccaggaccagattcacagccgaattctaccagaggtacaaagaggagctgtaccattccttctgaaactattccaaacaatagaaaaagagggactcccccctaactcatgtttaactcattttactcctcccagcatcatcctgataccaaagtctggcagagacacaacaaaaaatgaaaatttcaggccaatatccctgatggacattgatgcaaaatccttaataaaatactgacaaaccccaaatccagtggcacatcaaaaagcttatccaccacaatcaagtcagcttcatccctgggatgcaaggctggttcaacatgcacaaatcaataaacgtagtccatcacggaaacagaaccaatgacaaaaaccacatgattatttcaatagatacagaaaatgccttcaataaaattcaacaccccttcatgctaaaaactctcaataaactaggtattgatggaacatagctcaaaatattaaaagatatttatgacagacccacagccaatatcatactgaatgggcaaaagctggaagcattccctttgaaaactggcataagacaaggatacccactctcaccactcctattcaacatagtattggaagctctggccagggcaatcaggcaagagaaagaaataaagggtattcaaataagaagagaggaagtcaaattgtctccgtttgcagatgacatgattgtatatttagaaaaccccatcatctcagcccaaaatttccttaagctgataagcaacttcagcaaagtcccaagatacaaaatcaatgcggaaaaatcacaagcattcctatataccaataatagacaaacagagagccaaatcatgagccaaatcccattcacaattgctacaaatagaataaaatacctaggaatccaacttacaagggatgtgaaggacctcttcaaggagaactacaaaccactgctcaaggaaataagagaggacaaatggaaaaacattccatgttcatggataggaagaatgaatatcgtgaaaatggccatactgcccaaagtaatttatagatccaatgctatccccatcaatctaccattgactttattcacagaactagaaaaaattactttaaatttcatatggaaccgaaaaagagcccacatagccaagacaatcctaagcaaaaagaacaaagctggaggcatcacgctacctaacttcaaactatactataaggctacagtaaccaaaacagcatggtactggtaccaaaacagatacatagaccaatggaacagaacagaggcctcagaagtaatgccacacatccacaaccatctgatctttgacaaacctgacaaaaacaagaaatggggaaaggattccctatttaataaatggtgttgggaaaactggctagccatatgcagaaaactgaaactggaccccttccttacaccttatacaaaaattaactcaagatggattaaagacttaaatgtaaaacctgaaagtataaaaatcctaaaagaaaacctaggcaataccattcaggacataggcatgggcaaggacttcatgaataaaacaccaaaagcaatggcaacaaaagccaaaattgacaaatgggatttaattaaactaaagagcttctgcacagcaaaagaaattatcatcagagtgaacaggcaacctacagaatgagagaaaatttttgcaatctatttatctgacaaagggttaatatccagaatatacaaagaacttaaacaaatttataagaaaaaaacaaccccatcaaaaagtgagcgaagcatatgaacagacatttctcaaaagaagacatttatgtggccaacaaacatatgaaaaaaagctcatcatcactggtcattagagaaatgcaaatcaaaaccacaatgagataccgtgtcatgccagttagaatggtgatcattagaaaggcaggaaacaacaggtgctggagaggatgtggagaaataggaacatttttacactgttggtgggagtgtaaattagttcaaccattttagaagacagtgtggtgattcctcaagatctagaaccagaaataccatttgacctagcaatcctattactgggtatatacccaaaggattataaatcattctataaagacacacgcacacgtatgtttattacagcactattcacaatagcaaagacttggaactgactcaaatacccatcaatgacagactggataaaaaaatatggcacgtatataccatggaataatatacagccataaaaaaggatgagttaatgtcctttgcaggggcatggatgaagctagaaaccatcattctcagcaaactaacacagtaacagaaaaccaaacactgcatgttctcattcataagtgggagttgaacagtgagaacatgtggacacagggaggggaatattacttactggggcctgtggtggggtggggggctaggggagggatagcattaggagaaatacctaatgtagattgacgggttgatgggtgcagcaaaccatcatggaacatgtacatctatataacaaacctgcatgttctgcacatgtattccagaacttaaagtataataataataaaaagaacagatgatgtatccagaatgatttttttttctgtctataacctttagttagcaatttctatcaaggcaatgctaaactcattatgaacaggaaatagatgatacaaaacaaagcaaattaaaaaataggtctgggccaggtgtagtggttcatgcctgtcatccccgcactttgagaggctgaggggggaggattgcttgaggccaggagtttgagatcagcctgggcaacatagtgagacctcatctcttaagaaaaaaaaaaatttgccaggcatggtgtctcacacctgtagtcccagctacttgggaggctgagctgggaggatcatttgagcccaggagttggagactatagtgagctatggtttcaccactgcactctagcctgggctacagcctgagacccttactctaaaacaaacaaacaaacaaacaaacaaacaaacaaacaaaaagtcttaggagagctgattacagtttagcggaagcagccttttgactttcccttcttttaataccagggattttacttagattgcaaaactgtggatgttttgtggcaacttggagtctcaacatctattagcaaaaaagtaagaggattgtaattacagtctaagcttcggagctggttgggcctgacatttgagaaaatggataaggccagccctttgtctccctctgcccccacccgcttccctctctgggacccaagctctcttgctgcccagccaaacctgtcgtcttgagaaggcactgaagctgctgaccctttctgctctgcccaccaaaatataaccacccacagtctctgttcagagatggaatccagtgagatacctataatacattcacagtagatgtcagataatagaagaactcactcttctcatatcacatgggaaacacactgttgtcgcctttccatcctgtttcaacaattcagattatctcaagattcagaagctgcgatgttaaattaggggtcaactgtcccttgcccccctcccttgtgacctcactttcctgtctctcattgatacttgctgtctgcaaataacctggactctgggtacttttttcatgtgaaaggaaggattttgagctctttttggctaaagttgataagaaggattggaaagtagcttagttcctaattgaggttctctccctgtctctaaatataaatagaaaaactcatggaacatttgtgagagaagagttatatgtttagttgcttagaacattttattttagaaataaatatttagggatacagccattcatggtgttttcatgaacttatcccttatgaatgcatatgatatgttcattcacctctttgtagaagctttgatcgttttgcacaaaacaggaagtagtagtagtggcagtatggatttgggagggtgaagttagctttggccaggtgatctctgcatatcagactattaaaggcagcgcctttacagaatgttggctgggctgtgactcatgctttgctttgcactccctaaagaggctttatgtatcgcctctttgtcctttcccaagtcatttgaaaataaatagaagagagaataatgtgatcaggggctctaattgtatttattgcttatgtagggttgtagtagatacagggatgtttccttattctttatgtcttgcacatctgaaatgtgtcataataaatgatattttaaaaaactaaacagaacaactagttttgggaatttgtcctacatagtcatatgactcatctgcatagatcctaatatgatcatagcttggccatttccattttttctgtttttctccttcttaaacacaagtggaatttttattttatttatttatttattttttgcgtttttcaatcttggataggactagttgcttcccaccttttctgaggtacagaaaaaaataagtgcgtgctgccatttgcttaaagatcagcagtttccatctctgcaggtcagaaaggaagtgaatacaatgtattggatcaataagcacagatatttgcaatactaactataccaatttcaaaaacacagtaagttgtatatttaattgaaagttcagaaaggacaaacagtagatgacagctaatacagtttgaaaagaatgtttaaaatgtgcagacaaaagattatttgcctataaacaagattgataatttataatcatgtgatggattgaatctctttcataaatatttgaataagatgggatcaaggcagtaaagttgatcatgaagctttaccttgtcaatcctcatgagtgttgacaatacctgttgggaataaaccctgtagcctggctgaccaactgatatctatatcccaatccactggcacatcaataatttttgtaaagtaaaaagaaaaagagggagagggaactgtttgtttgatggtggatggagaaagtgtcccaggaaagaaagctacatgctggtgtcttagtggcagccaggaccaccctgtgtggacatgtagtttgtactctgcatgactcctgggggcatcattcacatagattcctaaaggaatgacgctctctatggttgtacaatctcagccctagtggtaatcatttatttggcaatctggaaatgtttccagaagtatcccttgtgaaggacaaaggtctactgtgtatcttgcatatttcattattaaccctgtgacttgtgctgagtaactacttaatatctattcagtgctaaaataagagaaaggcaactttaaaaaaaaaacctttttgagacataattcacatattataaagttcacctgcctatagtatacaatgatttttagtatattcatggagtagtgcaactatcaccacgatcaattttgaaacatgtcatcaccaccccacccccagaaaaataaacctcatgcccattaacagtcattctctgttcctctcttgccccagctcctggcaaccacttatctactttctgtccctacagatttgctgattctggacatttcatataaatagaaccatatactgtgtggcttttggtggcaagtttcttgcacttaacgtagtgttttcaaggtttatccatgttgaagtagcatatatcagtactttatttcttttttattgccaagttatattccactgtatggctataccacattttatttatccattctttagttggtggacatctgagttgcttctacttttttggctattatgaatagtgctgttgtgaatattcatgtacattttgtttgtgtggacataagcttttaattctcttaggcatatatctaggagtgaaattgctggagagaaaggcaattttaatttagaaatctctacattatttgcttttatatttaaagtcatcttattaatggtatatatctggcttggctggtaattctgggtcctgtatcaaacctccgccttacaatccccatccatgttgtgagccggtaggtgaaccacagaaaattgaaatgtactactgggttagtctctttgaacagggtcatacttacattgaattcactctgatttattattttgctactgcacttggaacacagacagtattcactaagaattggaactatagactagaaacagaggttccctgttttcattagtcaactctcaaaggatggaagcagccaatttcagactattctagggctcttgctctcttagttgcttgccatccttctttcttttggcctttttgcatttcattagtgtcacttacagagctaagagaacacagataattcatccaaagtatttttatagtctttaggtgaaaagaacttttaatatgtgtgtcatcttggtttctatgtcccttgtaaattatgttgtttaccctgaaactatgaagaagctgcagttgacttccttcaacctaatcttagcttctagtattgtgctattggagttattattgaggatgataaaaagagtgtatagtattgaaggcaaattgtttaagtgtgtaaattataatttgttttttttaaagggggttcactaacagactaaggaccatcagaaagatttttttaaatagaccatatttttagcaacgttacacatagttgtagtggttatgactttgcaaaataaacatcgtcttagaattgaggtcctagaattaatggacttaagtctgatttttaatgggccaaagctatttaaactgtacatgcattaacaattttcttagtggcatgtatacttgagtaggaggttataaagagtagacaatgagaatgatgctgtttgacttttaaagggaacattgtttcattggagaggaataaaatatggacttctctttaagcaaggcagtttgcatttctgttggccagatttcttgagaatgtgataaagcattagccccaccatttccagcatcctccatttaattcttcttagactcttttccacagaatgaaattgattgattcatggctgagggtttgaaaagagagccttggggaaaattttaagaagtgttccaggaggccataaagactgttgacaggtggccaagcccaggaaaaaagtattagtaataacaacagctcaccctacatagctcttaatcatatgtcaggcagtgcactaaacacgttacatgtactaactcatgtgattctcacaacaatcctatgaggtcaaaacttgtttttatccccaatttagatgaaggaattagggcacaaataggttaaggcaattgttcaaggtcacacagccacaatgtgagcccaggtggtctagttccagagtcagtactaaccactaagtgtgcagattactagaaacttggagacactccaactcctgaatatggtgcctagccagggctctggaggaagcaggcagggcagggcccaggtccctgccagcactttgccaaaatgaactggtgaactgaggcactgtcatgacctttgctgcttgaataatttcagacggcaaaagaagcccagtcatgtgaaattcctttgtggctagaagatgtcaacaggcacagatctagctcatctttcaagatatgcaattttttttcttaacagaatgaatgctcctgtatataatattgtcctttatggtggctggttcatagaaactgacaaagaagtcaaattaagagcagttaaaagttaaagatgtaaaagttaagtcacaagacccaagtagagtgagaagaaggtaatttgtgtgtctgtttaatccctggcatgacctttaatctctgctacttaaaaattacagatgcaatcttaactatggcataatgaaacaaagaccaccacttcttttttctttctgctttttgaagttgcgcagatgtcagaggaagataaataaatactgttaacagcttctggaagcataatgtgctttgaaagagtgagtcaaagctcgagccagggtttatggcctcagcaagtcgaggttttcctgatgacaaaatgaggccttggggttttggaggaagctttcttgaagaatgagcacagccaagaatggtgctacacttgggactctcctttgtcaatagaaaaagacaaaggacccgtttataaaatggatatcaagtagcagattagagggacatagttgtgtcaccggtatgatggtcgtaactgcaagttgtccaggttcttggtgttttgaacaaagaattggacaaaacgcccagcaaagcaaagaaagaatgaggcaacaaaagaacaaaagcagggatttattgaaaacgaaagtaccctccacagtgtgggggcgggctgagcagcagctcaagggcctggatatagaatcttcttgggtccaaatactccctagaagtttcccattggccacttcatgctcacttcatgtaaatgaagtggtagcatgcaatcagtctgattggttacagaaagccaaccagaggctgaagtgaagttacaaaggtcacactcctgtgcaaacatctggttggttgcaaaaagcaaccaatcagaggctagagtgaagttacaaagttatacttctatgaaaaggaagacttagccggcaatcagtctgactggttgtggacagcaaccattcagaggctggagtggagttacaaaattacaaatgaagacttgaccggcaatcagtctgatttgttgtggacagccagtttcccatctgacatgcagaaaaggcagggggtttgcaaagggagtagcttctggtctttttgtatttttttttcttttttttagtagagacgggagttttcaccatgttagccaggatggtctcaatctcctgacctcgtgatctgcctgtctcggcctgtcaaagtgctgggattacaggtgtgagccaccgcacccggctgcttctggtccttttattacttaggcatgaaaagttagggttttcctttcaatttagtcctaggaagttggcgtgaaacagccttaggttccctgcctccagaccctattctcctgcctcagttgaattgtatttcagcaattgaaatcagctaatcgaggacagacacctcatatatgttacccacctactctccctaatatgtagaatgcctatatataaaaataatagcaagaaacaataattacaacttattgacaccatgtgtgccctgtactagcatcacctccattttatgtgggaaagaactgtgttggagggtgaagtcactagcccatattacacaagtcttttaactacagagtcagctttcttaaccactggagcccattggggttggaataaggctttggaatatcttctggggttaacgggggaattcttgaaagttttctcaataggaaagtcacgaaaaagtggtatcgctgctggaaggcaggatggtttggcaacttttgaactgtggtctgactgtgaagtgataagagtctgaattaatatgctcaattagagtcaaaaggagaggcaagatggaagactccctgagaaggaatgggtgatccttgagacatgggcactgaccagatgtgggaattagggaaaggagggagtcaaagatgaatccaagatctccagagtagtgttagaatgcttgtgccatgaatagaaatggggaaataggagattaagccaatttggaaagacttcttggcctgtgttggtggcagggcactgccccacaaagcatactggttagtgggaaatgtggcagctctttcttcattgtcagagcctttgttttactacacagaagcttaaaacgctggatgcttgctttcctagactcccttgcatgtgactgagatccagtcatgaggcacaggtggatacttattggaaagatttttctctctgataataaaaagtctagcaagaaaaacctcttcctgctttgggtttcaaatgcaaggataccatgatgtcatgcgaggagctgctgcagccattttgcagtcttgagggacagaccaagaaaattaggggaagctgactcagagccctgacactggggagcccctgaaacaacaccaggaccgtctgcctctcttatgtgaaaaaagcaccccccaaccctggtcaagccatttttagatgagttattttgtgatttgcagccagagcatccaaattgatgcagactttgtgcaggtcacagatcaccttgatctgagctttgctgtgttttctattttggatattaattttggaaaaacaccatgtgggaaatgatcatcacaattgcccactgaagcctccaaaatagtaagagttccagaaagagagagagagaatgcactttggataccatttctagaaaatgagggctttttaacaaaagtctgtaaaggccgaacagcctggcccagatcttaggcccgctttgctgctaggtgagagcctctgttaggtttcaatagtgcaatgtgcttctcaaatgacaacggggcccattagtaaattaaacattcccatagcccctagatacaaactgggcgaaagaagtattttccgttttcagaactgctgctcttttcatttgcttcttcccaccttccttgacatttgctggtgtctgctgccaggaaggcatgtttagctcagtgatggatgtgcactaatgagaattagcctgctttgtggagcttttgaatcagagcaagtatgctgttctgaagggctgaatgactggttgattgaaaagtaattgattgcagaatttcaaaatgagattcaaaaggtacattacaaactagatttcacaaaagccaactttctttgtcatgttcttcttttcggtcattttatcctttttaagtttacaaaattattttagaatttagtaccaacttcaccatctgattcctgaagcttggggtattatatacatataaagtttatgataaattctcatgataaggaaaaaaaaccctatgctacatagattctagtcctgactccgcattaataactgccactcagggaaaattgtttaacttttctgagctcccattgttgttgataaaaatgtttgaataaatcatgcatgagatcctatacacgtgaacttagactttctatggtaagacacagattctcatattctacatggtattgggctgggggtcttccctatgctcctctctgagaaaacactcctgcagacagagagcaggcaaagaagcctcttgctagaggagtaatctcaacaaaatttggttttgatcgtgggattctgggtggagatgctagataaaagatgatgcagttgggcacggtggctcacgtctataatcctagcactttgggaggccaaggtgggtgaatcacctgaggtcaggagttcgacaccaacctgaccagcatggtgaaaccccatctctactaaaaatacaaaaattagctggccatggtggtgggtgtctgtaatctcagctactcgggaggctgaggcaggagaattgcttgaactcgagaggcggcggttgcagtgagccaagatcgtgccactgcactccagcctgggcagcaacaggagtgaaactccatctcaaaaaaaaaaaaaaaaaaaaaaaatgcctagttacatttgaatttcagataaacaaggattttatttttagtataagtatgtcccaaacattgcatgtggtatatttatactaaaacattattcattgtctagttgaaatttgaatttagctgggagtcctgtatttgtattggctaactctggcaaccctgattctgagaggaataattgatggtaatggcctgagcctaaattgctcaaaataagcaaagaggagctgcagaggattcttaggtcttgatagatatggtgtcctgggaggggctgagtaggttcggctaaaggtgaggggagtgaagggactaagatacatattaggagcctggctaggacgagaaccctccctcctttcttcctcacgcattcttaagtatctcctctacccactttgcttttataaaccttaattagctttaacgtaaagtgaaaatattggccgggtgtggtggctcatgcctgtaatcccaacattttgggaggccaaggtgggcggatcacaaggtcaggagttcgagaccagcctggccaacatggtgaaagcctgtctctactaaaaatacaaaaattagccgggcatggtggtggccacctgtaatcccagctactcaggagactgaggcaggagaatcgtttgaaaccggaaggcagaggttgcagtgagctgagattatgccactgcactccagcttgggcaacaagagtgaaactccatctcaaaataaataaataaagtgaaaagattaactttctatgataggctgtcgttttggcatcctttttacggtccttgttcctaattttgaaatgagtgggtggaccttatttttctcattctccctgctcacggccccctccctaattcaattaatatctgctggtgtgtgccccagattgattttttttttttttgccctctgtggactagttatttctcaacagaaaaatgattgccaaatttctgaaattcttttctaaacttctgaaccttttcaggtgttatttatgctcatcattcagttgtttgtacattcttcactcacatagcaaatctttaggaagtaaaagaattgcactagggttttaccctggtatgtagctgtgtggagcacttcagaggcagaattaacattgtgcgctactagttttattcctgtttgtcaaacaagatcacttaacacctctgcattgggtaaccatgctttcccatgaagcgagaggactgctgagcttgagcaatggcggggacctctcccagatggtaagtgttttagggcacaaggtcattatattaaaagtagcaagagaatgaacgggaatcaggcggaacatactgatactgacacatgtgtggcacaagaaattgctaaggtaggtgcctgatcgtaagggggtgtcccctccaaatattggcacttgaaagcagccacaaaacctggtattttagttatttatcctgagggtgagtagtgggagggacctttcgtggtaccctctgtgtggtgcttgctgtggtccttgtgttgtagcctttgatgtccaatgtgcaagatacagaatttggcaaatagaggtcgtttgtcaaggttggttctaaaggggctgcctaagtttgtcatctatgcaacataattcaaaggcctgttctgttaaaaaacaaacaaacaaacaaactcttaactacctcagaaccacgagtgaatgcagaacatttattcagaacagctttcttctatttaggcaccaaggctactaaaaagaaaatgatggccccaccatctgggagcttacaaaattaagcagatggttaaaatgcagtgtaacaagaggtgtggtgatagatcacactgggttaggagcctgctggaggcacgcagtacactgaggacttccgcaaagagagaagcctgtagacgcaggagattgtaagcgtggacactgtaaaagctgctattggtgccatgcccaggtccccttaactggattggtatccccagctgtaagctgttgtattggctgctgaggctcacagctgcactctcttgtggaaaattgtgttctgctgaaaggagcaaaaaaaatgaggttacataccttccccccagggatggcctagaaccaatgactgatcaataagaaagtacaaaaatctggccttcttgcatcaaagcagacaactctgtgtgcccttcctgctccagagatctgatgcaatcaggctgagaacagacttcagctggaaccacattttcacttctgtgcctttctgcttccttcattgccctataggattctcccaagaacatccctcagtacatcgcttgtaatgaatccctgtctctgactctgctcctaggaaacccctgatagcagagaagcagaagttgagctattctggtgttcagggctcatttttcctgatgtggggagagggaatagacgaagtggttgggaacattggtgaaggtctgatgtgaggcatgtgagcaatgtggagaatgggagcagtgtctgatatcaacttaggtgagagactaccatatgtgtatggcaccagtctgtattgtggtatcattttcttcagcactcagcagcctggggtataaaaacacagacatagatgacacaaggttgtagttctggcaggcggatgccataggaagtcaaggaaccaggcacgacaagaaaggacttgaagataggaaggaatgactagtttgagagaaaatggaggtgtcagtggaccaaagctgttcatacaatggaagaatatgtgtgatgaccaaaatacaggtaacaagtgtcaagattaggaggctaggctagtgtgttgagagtttggaacaggagaacttaagatttgaaggtttaagcatttctgcctaatgacatgtctaggatatgccacagcacaggtgtgtgagtgaattggagggtgtgcttctggggtgaggagggcagggcactgcagtgttagggagctggatgggccatcctcttggacactgccagcactgagccacagtagtggtccaaggaattcacactgcacatgcagctgttacctgccccaagtcccagagatgccatcacttcctgtgtcaggccttcgtggagcaggtgtccctaatgaaggcagtgggcaaagacaaatgacttggaggtatggaatttcccaaggagacccttttgtggtggtatagaaaccaaaccacttgttaacaggttaaatatttcccatctttctgttttcatgctgacataggtgttcttggactcattgaccctcctggtaaatctcccagtcaggagagttccacccttattggatctcattccatcatcctcctatgtatttcgacttgctgtccttgtctcctaatcatctcaatgacccaggcattgaagaatgaagagtgccatgatattgtaagagaagcagtttgatgtagtagacagggtcatgcttttccttctgcctggattgttccctattcccttcctcattcagtcaattcttactcatcctttccatttggcttaaatgtctctcttctccccagagtatttcagagtccacttctgtattatatactctcaaagcaccttattcccctttgtgactcttatcacaattataattaaacaaacaaaaagattatttcattgcttaaggtctatctgacttgatagcatgtaacctctataaggataaggctgtctgtgttatccctagctgctagcatggtgccttacataaagaatgtgcttaataaatatttgtagaacaaataagagacgtatatggaactgagagtccatttctgttttaaggcatgttcctatttagctgtgtgatcttggacaagtcacttcagctctctgagcaaaataacttcttactcactttaacattgtatgatttctgatttcacagtctatcagccaaacaccttaacaactcttaatcccaacagtatgtctgggctaactaaaagcattcatctggaacttcttaaagtagcttgttcctagagaaactatttttccttgtgtttcagtaatctctttctaagtaaaaaataattcccacatttagtggcttaaaacaataatttgctctctcaaataaacaagaaaaaagtaataataaagatcagagtggaaatcaataaaatagaaaaataaaaacagaggaacataacatagagactgtgcaatgtttggggaaagaatatccaaggcagaggtactgctaatccacaggtcctacagcaaggcatgcctgacatgttttttaaaatcagaaaagagggctgggtgcagtggctcatgcctgtaatcccagcactttgggaggctgaggtgggcagatcacctgaggtcaggaattcgagaccagcctggccaacatggtgaaaccctgtctctactaaaaatacaaaaattatctgggcgtggtggcaggcacctgtaatcccagctacttgggaagctgaggcaggagaatcacttgaacctgggagatggaggttgcagtgagccgagattgcgccactgcactctagcgtgggcaacagagcaagactccgtctcaaaaataaatacataaataaaataataaaaagataaaataaaataaaaatcaggaaagaggtcgtgcatggctggagcagagcacccaaagtgtatcgagcccctggtcaatgtgaggacttcggcttttcctttgagtatgatgggaaacccctggatggttttagcagggaagcaatgcaatttgaagtcatcagctctctccttctgtgtcaattatagtttgttctcttgcctctagtcatacaaagttgtatttccctggattgtgagacagaaaaatctaattctatatgatcagagataggctgttgctttgggcaggtttttatttcatgtttatagattaagagtttgcactttcagttcccagggagttcacacagatggggtgactgctttgtcttaattgcaattgtcatgatgtatgcgtactttcctagaactggactgaggctcagatggatagatagttcaaggaagatagattaacagagagagggagggagaaagaaagagagagagaatagattaaatggatggatggatggttagattaacagacggacaaaataaatggatgatgataggaggaggagagagctcgtcctctttgaggcagtgtataaggaggactggttgactttttctttctttgtgaatcacaaacagagtttagaagtggtatgttttcattaacgctaccttaattaatatccccttaatcatcaagtatattccattttgacaaaatagaaactgaattccttcttatctcccaaaggcaatggaaaggctagagagagctggcactgtgctattacaagcagatgagaggcatatttgctgaataacgagagtagctaacagtactgaactttgcccttttggtgtgggactctttctttcctgaatgttcaataatgtctggctcttttcctttgtgttctggttttatgcaaacacaaattacactcttgttgacttcactgtaacccatgaaattaaagaaggggaaattggagtcctatagaaggcagtttcaccagtcctgcctcttggatttgtgcgatggaaactgagaacagctgtatttttctaaccaattttatgagaaaagaagtgtccccagcagtaatcagcacaggcacatgataggaacagacagagatgctgctttaaaatcatatattctagagctgaaagccatctaagagagcatccaattctccctcattgtataaatgaagaaagtaactaaaactcggaggtacctgttcacacttcttgagtatatactaattatgggaagcaacgtggcatcacagaaataccacaggccttgtggaagtctgtgtgggaatcatagctctgccacttcctagctgctgtggctattgggcaaattatattatctctttgagccttctctcatctgtccctgcttcatgggctggttataagaatcacatgatataaaatataaagccctggcacaaagtagatagttaataaatagtagttatgattagctcgcttttgttgctagtgacaatacagagtaaaaaccatctcagcaaatacttagaataggattttaaaatgtcaaccaatggcaaacttgtttgaagtaaatttcaatatactgaaattccaatataattcagggaaacaaacatttttatataaaatattgtgctatacactagagttagttcaaaaataagaacaagatctgggttctgcttttaaggaaatgagagtagacatgcacgctaggctgcctttcagtgagggccgtgggacgggccactggggaggaggggacatgggtctctgggtgcacagaagaggttcttcctggacaaggagctcagggaagtcttcacagagaaagtaacattcgagaggtttttagaagggtctagaaaaacagattgagggacattcttattgaagggggccccataattacaaatacaaagtatatttagatttaaccaactcctctgtttaaatgagcatagaatatgtgaagggcaaagcttaaaataaaaatgatagctaccacttacggaattcactcatgtattcactcttttgctcgttgtgcaactctgtgaggtagattattatctccattttgccaaagaggagacaggcatgggcaggttaaatgtgttgcctaaaggcctcacagctggtaagcagtaccaaacttgaattcaggtcatctgacttcagagtccatgctccagttcggacattagacagtgagcttgactttttctgctagccgctccagatctataccctcctcttctccctgctgctcggggacccaggatgctgagctgtgtgggctctgtcagcatgctcccttggccctggtttcccgtcataataatggagggaaatgggagatggggcctcaggtttgccagggctgtatccctttgttagaggacacagctcctgttggccagccgctcttgcagctacaggtctccctgtgttgaaaaactcttctgtctccttgtcccaggacagctaatgctagcctcagaacacttcaccatctcatgttggttcctttaaccctgtccctgtctcagtgaagatcggaatttgggggttataggataatctgttcagctttagtggatactaccaaatagtttcccaaagtggttataccattttttttcctactagcagtgtaggaaagtttcagttgcttcccccttttgccaactcttggtattttctgtccttttcattttagccattctagtgggtacacagtagtatctcatttgtgatttcagttttcatttctctgagaactatggaagttggataccttttcgtgcgttcattggccatttgaatatctttggtaaagtatctaaatcttttaccctttttcttttctctttcttctccctctctctctttttttgtttttgagacaagtgtctctctattgcccaggctggaatgcagtggagtgatcccagctcactgtaacttcaaactccttggctcaagagatcctcccacctcagcctccatagtagttgggactacaagcgcacaccaccacacttggctaatttttaaaattattttgtagagatggggggtggtgaatcttgctatttgctcaggctaatcttgagctcctggccctcaagaaatcatcctgcctcagcctcccaaagtgctgagattacaggtgtgagccactgtgcatggcctttttgcccatttttaaattagattgtcttttcttttggattatgaagttatttatagattatgagtaaagtcctctggcagagatatgtattacaaatatcttcactctgaggcttgccttttcgttctcttaagcatatatcttttgatgaagagatgtttttaattttaatatactctatatattttgtttctttgtgttactatttgtaaaaataataagaaatacacatattgctctcggcccacagtccctgatacagagctcttaaaacccttgtaatttcctaagcaataaggatgctaggagaaccttttgttctaatattcgaccttttactctggttcctgacttttaaagtccttaggaattttagagcttttaaagtccttaggaatttcctgggcggcaggagcatcatttaataaggtagctcttggtggactcctggatgggagctggtcaccataaagactaagccataattataagctggggtctttcagccctaatccaccaacttgccacaattctccagagaagggaaaggggctagaaataaagttaatcactgatcatgtctacgtgataaagcctccataaaaattcctaaactatgggattcagggagcttctgggttgacaaacacatctgcatgccagcagggtggtataccccaacttcatgggcataggagtgcctgcacatgggaccctttcagacctcgccctatgtatcttttcatctggccagtcatctgtatcctttattatatccagtaaacataagtaacgtatttccctgatgctatggtttgaatgtttatcccctccaagctcatattaaagcttaatccccaatgtggcagtattgagaagtggggtctttaagaggtctcgagggctctaccctcatgaatgaattaatccattgatggattaatgggttattacggtactggaactggtggctttataacaagaggaagagagactcagctctctggcatgtgatgccctgtgccgtctcgggactctccagagtccccgccatcaagaaagccctcaccggatgcagcccctacaccgtgggctccttagcttccataactgtaagaaataatttccttttctttataaattaggcagtttcagatattctgttataagcaacagaaaatgcactaagacacctgagttctgtgagacactctagcaaattaatcaaaccaaagtggaggtcatgggaatccgatggatagctggtcattcagaagcagaggccacattctgtgcttgtgactggcatctgaaggggggtgggggcagtcttgtgggactgaaccctcaacttgtgggacctgacactatctccaggcagatagtgacagaattcaattgaattagaggatacttagctcgtgtccactgtagaatctgccagagaattgcttggtgtgtggggaaaaccccccaccctctggcatcagaagtgttgaacgattttgtgagagtagagagattcgaagaaccattggttttacctatatccttacatggctttgtatggtttttaaaaaggcatgtttgctgctacaatatcataagaatgttttcctgtgctttattctaaaagctttctggttttatctttcatatttggatctgcaattcatttggaattgatttttgtgtgtgatgtgagattagagtcctgatacgttttttctctcgtatggctatccagtgaacctagaaccttttatttaaaatattctcttttccatcagttcactgcaatgtcatacttttcatgaatcaggtgactgtatacatatggttgttttcttgtatgctatgttctatcccactggtctatcttcttgtctatccttgtgccaatattatacaatcttgattattatggctttataatgactcttgataactggaagtggaagtcttccagctttgttcttgaagattgcctcagctattcttggtcctttgcattttcatatgtattttagaaatagtttgtcaacttccacacacacacacacacacacacacacacatgcctagagtttggtgaagattgtgatgaatctataaattcatagaaaattaacatctaaacatttcaattcatgaacgttatgtttaggtcttctttaattttcccagtaatattttgtggttatcagtgtaaagttcttatacatatttcattagatttattcctatgtgttcgatttgctatagtaaatagtattctttttaaaatgttgtcttttgtttgttgctattatatatatatattttttgagacagggtcttactttgtcacccaggctggagtacagtggcatgatctcagctcactgtaacctctgcctcccaggttcaaacaattctcatgcctcagcctcccaggtagctgggattacagacgtggaccaccacgcccagctaatttttgtgtctttagtggagacagggtttcaccatgttggccaggctggtctcaaactcccgacttgaggtgatccacctacctcggtctcccaaagtgctgggattacaggtgtgagccacggtgattggccatataattgatttttgtatattcaccctttgtctagtgatcttgtaaactcagcaaagtatatctgtggaaggcatttggtagatatcctttattagtttaagaaaattatcttctattctgtttttctacacttttgtttaaaaccatgaatgtgtgctgacttttattaaagacttttccatctcttaagatgtccaaccctgttttgactcagctctaggacccaattctatagccctttccctggtcttggctttatccccacaatcacaaaaactccatgaacaaaaaggaacaaacaaggacctgaaccgaagaagtgccagtaaacatggaaaggaagagacaactgtaagagattttgatgttctgcaatataaatgttttgtacagtcccagatgtgttgagagagaagccgacttctcaaaaaaattttttttttttgaaacggagttttacacttgttgcccaggctggagtgtaatggcacgatctcggctcactgcaacctgcacctcccaggtacaagcaattctcctgtctcagcctcccaagtagcttggattacaggcatgcgccaccacgcctggctaagttttttgtatttagtggagacagtgttttaccacattagtcaggctggtcgtgaacacctgacctcaggtgatccacctgcctcggcctcccaaagtgctggaattacaggcgtgcgccaaaatgcccggccgacttatcagttttttaaactcctgcctccttttgataaacataaaaaatccacatgaaacttttgtttaatgtacgtattatggaaacaataagctattttccaaatataaattttaatatgattaagctttttgaacttttaaatatagattgcccttattagagattaataatatagtatgtgtaaaagcaaattacacattctataatcccctgcccctaaagtccgatacatcctccctgaaagggtacttttctccttcactttctcctaattgaaactcactgaaatagcatctacatagaacatcactgcatggtggagcggcagataagctggttaagcaatctatcattactatcatctggatgtcccaggatggttggggtaagtagaaatgtatgaagactctaactggcaatgggattttatcattgaaaagtgcagagctggccaattcagacccaagttgcaggtgtacctgggagaatacacacttgtaggttttcaaatttactaatatttaagcagtttgattctctacaattacttcaacatttgactattgggcttgaatttaatgaatcctggtgccctcttgtggacatgagagaatgtacaaagagtatagctttgagttcttttcattttaaggattactttgtgtacccatgtcccattaacctaagataactcaataggtagaagatctcaagtcacacagccaggcataatgttgccaattataagccctgtgaacttaagattccttatctgataaatggcagtaacaatagtacccaccttactaaggttcttgagaagattaaggatttaaggaaattcccttccattcctactttcctaagattttgtttgaaaccatgaataggtattgaattttatcatatgttttttctgcatttttaaagatgtacacttctgttttgactcagctctgggacccaacactacaacccttctccaggcatggctgtacccttactttatacatccatacatacaattggccctctgtatctgtgggttctgcatctatggattcaaccaaccacaaattgaaaatatttgggaaaaaaataataaataataatacaacaataaaaataatacaaattttaaaataatatagtataacaactatttacaagcatttaccttgtattaggtattgtgacttttttttttttttttttgaaacagggtctagctctgttgcccaggctggagtgcagtggcatgatcatagctcactgcaaccttgaactcttgggctcaaataatcctcccacctcagccttccaaagagactacaggctcatgctactatgcctggctaatttattattattattagtttttgtagagatagggtctcactatgtctccaactcctggcctcaagtgatccttctgcctcctcctcccaaagtgcttgggattacaggtgtgagccaccatgctcagcctagagatgatttaaagtatatggaaggatgtcatcaatgatagactggataaaaaaatgtggcacatatacaccatagaatactacgtagccataaaaaaggatgagttcatgtcctttgcagggacatggatgaagctggaaaccatcattctcagcaaactaacacaagaacagaaaaccaaacactgcatgttctcactcataagtgggagttgaacaacgagaacacatggacacgggttggggggagggcatcacacaccagggcctgtcaggtagtggggggctgggggagggatagcattaggagaaatacctaatatagatgatgggttgatgggtgcagcaaaccaccatagcacgtgcatacctatgtaacaaacctgcacgttctgcacatgtagcccaggacttaaagtatgataaaaaacaaaaagtataaaaataaagtatatggaaggatgtgtgtgtgtcatatgcaaatactataccattttatataagggacttgagcatccatggattttggtgtctgtggatgagggggcctggaaccaatccctcacagatactgcaggatgtatcttagcctggcacatagtgggctctcaataatgttatctgtgtttagtatcaatcatcttaatcaattatcaatcccttaaaggaaagggaagggtatgaaggatatagtatcccaaaacagagtggctacagatactagtaacctctcctccccagtcccatcctacctcattcctgattccctgcagcaactactcaactctcaactatttctttttatatttatcatcatatttttaataacatgttttatggatcttcttcattttttttgtccatatgtagtattatctattgactttctattatggaagatgaacgtttaactctcttacagtactccctccatacttcctttcccccatttatgatcccatgtatgtaaaaataatgtactctattttatatatttggtcctctccataataaccaaaaatatggaccaaggcataaaaggtgaatactaaaaaacggaaccttgtttcacattattaatgtcaaataagcctgaactcttcttaaatgaagcaaagaaaaaatttataatgaaaaagattataatttgcaatgataatggagttatcacataactttatgcaacaaggaagaagaaataaaaggagaaggttttaatcacctttgttggtccatgtctgatcaagcagaggaaaactaaaaaggacataaaatatctaaacaatttaataaataaatccaaatgtgattccagatagactcatatgaccaaataacacatgcaaatattgaccttatatcaggttatagagaaaactgttttccaaagcagctgcaccattttacactctaatcagcagggccaatttctctacatcttcaccaatacttgttattatgtctttttgatcatagctgccttagtgggtatgaagtggtatcttattgtgattttgacttgcacttatttaatagttaaagatattgagcatcttttcatgcacttttggtcatttgtatctctctttttttttttttttgagatggagtctcgctctgttgcccaggctcgagtgcagtggcgtgatctcggctcactgcaagctccacctcccaggttcatgccattctcctgcctcagcccctcccgagtagctgggactacaggcgcccgccaccatgcctggcctggctaatttttttgtatttttagtagagtcagggtttcaccatgttagccaggatggtctcgatctcctgacctcgtgatctgccagcctcggcctcccaaagtgctgagattacaggagtgagccaccatgcctggccggtcgtttgtatatcttcttatcggaaatgtctatataaatcctttgctcattttaaaaattgaattgtctttttattgttgaattattattgaattctaagacttgtattgtagatgcaagcccctatcagatacatgttttacaacaattttctcccattatcagggttgtttttgtattctctttatgttgtcatttgaaacacagttttaaattttgatgatgtccaatttatttttttcttttattacttgtgcttttgtaatcgtattcgagaaaccattgtctgattccaggtcatgaagatttatgccagtgttttcttctgtaagtttatagctttagctcttacattcaggttttttttgatattttaactttttgtctatggtatgagctaagggtccagctttttctttgatctgtggatatccagctggcctaacatcatttgttgaaaacattattcttttccccatttaattttcttggttcccttgttgaaaatcagttgaccataagtatgagggtttatttctgaactcacaattctattatattctatttatgtctgttcttctgccagtaccatgctgtcttgattactgtggctttgtagtaagttttgaatttgaaagtatgtcttccaacttctttcttctttttcaagattgtttggatattctgggtcccttgagtttccatatgaattttaaaatcgcttttcagttgctgcaaagaagccaagtgagattttaatagggattacatttaatctgtagatcaaattggggaatattgccatcttaacaatataaagccttccaatcaatgaacgtgggatgtccttcatttatttaggtcttttaaattttctttcaacaatgtttcatggttttcagtgtatatgtgtcatggtacatttttgctgccataacaaaataccttagaccaagtaatttgtaaacagcataaatttgttgctcatagttatggagtctgggaagtccaggatcagagcaccagcagattcagtatctggtgagggcttgccttctgcttccaaaatggcaccttgttgcttgactttacatggtggaaggcggaaggacaaaggaatagagcccttccttcaacctgtttcatgacagcactaatcccattcatgaggttggagtgttcatgacttaatcacttcccaaaagacacacctcttaatactatcatactgactattagatcctaacatgaattttggagggacacatacattcaaaccatagcaatatgttttgcatttcttttgttcaatttatttctaagtatgttcttctttttgaagctattataaatggaatttttttaaaatttcattttcagattgttcattgccagtgtatacatatccccccctccgaatccagcatccacaatatttttaataatgacaggatccggttagtttttgtagtacagctggcctcttggcctctggtgtagggtttggagtagctgtgcaggtacctggggccttactgaaatgcttgtatatttcttggtccttgtgaggatgaaagagcaggacaatgcatagactttgggggcgtccaggtcaggaccttgccctccaattatgatccccacaaccattcattttgtgttcttggccaggaaacttcattttcttgatcatctggcctgttgctgccactcatgaatatcctctacagcacaacttggttgaaggtggagttggttcctctggccagaaacatgtaccgcttgaccaacagctttagatcaatttcctggctcttgagtttctggcactgggttccttgtggcaggtgtggactcccatgatggtgcctcctactcagccatgtccaaaaaagtgagcactctcagactctttaaatactttatttggaatttttggacatttacccaatttttacctaattttttccatatagaattacacatattcagaagtgagctaagagtctttttcttattggatcatttaggttaccttaggtctgaaattctcagatatgtattgctctcatctactagatccttgaaatttgccaaaatttaaattatttttggcaaaattgagcaaatatgaacacttccaatgtcagtgaggaagtgttaaagtgagtacttccatatactattggtgggactgtgaaatggtgcgggcactctgaaaataagtttgccaataccaaaatcctcagttaagattgtaattttagaccccgtacttttccttctataaatctatcattaaaatactgagatccagaccaagatttatatataagacctcctcagtattattttatagtacaaacgtgttgaaatcaatttcaatgtgccataaaaatatttatctatgcattaaaaaaggctgaaaggaaatatatcaaattgtaataatgttatctctgaagaatgggatgaggtaaagtcagtataatcagtaataaaaaatgggggcaagagcacagattgtactagttacagacttgagtttgagttctctctctgccagatgtagctgaatgactttgggcaagttacttaacctctctaagcctcaatttccttaaatataagatggtggtaataatagttgttgccttatagggttactgaaagaattgagtgagatatacacaaagtgcttagcacagcagttgatccacagtgagtgctaagtgttagctctcgttgtcattggtcacctggccttgtcatatacaactgcacaatcccctggaaatgtttccactgaatgagacacctatggatttggacagactggctttttctgccatgtacttcaatggccttagttgttgaggactcgatatgtgcatgtgatgtgagtgtaattgaccagagaggtagtgtggcacaggggaaagaacaaggagactttggtcccaatctaggtcttggttccctcatcagtgaagtgaagggagctggactagagaatttctaagatctcttctggctctaaaatgttcatttctcaccaggcacggtggctcacacctgtaatcccagcactttgggaggccgaggcaggtggatcacctgaggtcaggagttcaagaccagcctggccaacatggtgaaaccccgcctgtactaaaaatacaaaaaattagccaagtgtggtggttggcgcctgtaatctcagctactcgggaggctgaggcaggagaatcgcttgaacctgggaggtggaggttgcagtgagccaagatcacgccactgcactccagcctgggcaacaagagggaaactccatctcaaaaataataataataataataataatgccacagcaattgtgaatttagacttttgtctcctaaacacaaggtggcagcaaaagactaggctcttggctgccatttgccaaaaccagtaggataagatggtattatttaatttacactatgttataaagtaaaagatctaggtggcttaagatcactacctgctcttagtggtttctatgaggcccaggtttaatgtccctagaattatgcttttatcgctataatcggaattcccctactctcaatatatccactgaagtcaccactcaacaacacctctgcctacaatttctccaaggctttttctatcacttctactgcttcttggaaaaatacccttcaagttttcacctgtgatgagcaggggtcttgctggcagaatggcagctatgtgctttacaagataaaaacaacttctgtcttccaggatcggggaggatttgcagtatgggggcttggtagtgctctctcagggaaaaaatttcaaataaaacacccatgtgttgccagtctattcaaatatgttccaattataaacaatagtaggaaatctcgatgatctgtgggttgggtttctgtgttccttggttggagctgatcactcctggccaggtggggctggaaaaggatggtgagaaagtgggagacagaccatgaagtgagatgggaaaccccattgcagaaacggagtgaggggcctgtcctcagaatctaaagaaggttgttctgaagatccctagggaagaggccaggggcctagttgagacacaggtgaggtgaccctcaggagaatattttcaacctgaggtccgagggagtgggcctgaggcctaaatagaaagatcctctttcttcagggaccttggggatttccaggcagaagttgacctaagagaggcagtgggagtagaatggaagggctaaaaagatagggccaaaggtcaagttaaaggattgacatgtagactagaaggaaattgacacaagtaccaggaagaagttgtttaatggttctgatagatgccacatgacttaagcaactggaaactgaccttgcaacccctacaatggcattgggctcataccctgagattccaaagcagaggggatctccagaggagaggaaggagggcaggttataaacagagcctttttttttcagagaggatcctcttccttcttttatttccttcctgctaagtggtaagagcagaaaatcattaaggaaagcagcagaagaaactggcagatctggaatgtgggccattttctcaccacaatgtgggcttcttcacttccgcaggattctacctgctttaggggtcacaccctctgcagggtgcttggggatcgagggacaaggagggaaaatgttttaacctttaaactggtggcctttttggtggttactatctaaattacctccaaaatgattgggggtgggaaggggaaagaaaacctaacctggacctaagggacttgtggtagggatcggatactgcaatgagcgtggaatcatacatttctctttcaacttgatgaggtgctcccacggagggacagttagcagaaaatttggtaaaggccttatcacagaccagagatatgaccaactggggtgagctttaaggaggaactagggtagaaaatggttaatgttttgctgaaatacagggaagaaacaaggtggattggatcataaccaacttctttcacaatgtcataaaagtacccaaactgtggagtgcacccacatctacatgagcaagtcttgtgaattgctttgatgcttgcaccgtgccatctcaggcctgccatggtgctaagtcaccctccacagatgcagggcttccagcttccacctgagagcaggagcagtaggttaactttgtgtcaaagactcatccttcctttcctttgacttcaaaggtcccttggtggaactttctactgtcgggtctttcatgattccctatcagaggttttacatgtatgctttcgactctgaaagggagacaatgccagctaaacacaaggaaagctgttcaggctgagtgtgggagaaggggaagctggttgctgattctaattctgatgtttgaggggaaaataatatgtttttttttttgagacagagtcttgctctgttacccatgccagcatgatattggctcactgcaacctctgcctcccaggtttaagtgattctcatgcctcagcctcccgcgtagctgggactacaggcacctgccaccacgcccagctaatttttgtatttttagtagagatggggttttaccatgttggtcaggctggtcttgaactcctgacctcaggtgacccacccgtctcggccttccaaagcactgggattacaggcatgagccaccgtgcctggctggaaaataatacttctatctcactgatcacatttaccggtagtatgctttaagcaggaaacaagaactgggtaattgcggcagaaaagcctttaaaagaaaatgacttcattggcattagcaaacacctacagagataatatctctgaccttagctggcaggcactgagaaaattctgaggaatagagggggagtctggaagacttgggactttgatttttcttatccgggtcagacattgatctttaaaaaatgacatacgttttatagtcattaacttatcacttaaaatgttctgctgctacagttcctggagtaggggtagaacccttcagtttattgaggaccaaagacctacattaaaagtaaatcaaagcctaaagggaagcaaaaagcaacttaattgacttcaaaaatttttaagccgttcactggtttaagtaaaaaatatgaagcatagtaacaattttcagccactctggaaaacagtttggaagtttctcaaaaagttaaacatggacttaccatatggccaggaattgcactgctaggtaaatactcaagaaaaatgaaaacatacatccaaacaaatgttcatagtagcattattcatgatagccaaaaagtggagaaacccacatttttgttaactgatggtgaatacattaaatgtggtatatcaatataatggaatattatttagccataaaaaagaatgatgtactgatacatgctgcaatgtggagaaaccttaaaaaactgaaagaaggcagacaccaaaggccacatattgcatgattccactcatatgaaatgcccagaacaggcaaatccatagaaaaataaagtacttcagtggctgccaggggctggtttggtataggggagaatggagtaggactgcgagtggatatgaggtctcttttgggacgatgaaaatgttctgaaattagatagtggtcctagttccacaactctgtaaatacactataagccaatgaactgttcaatgaaaaagggtgaattttatagtatgtggatttaattttatgatatgcgaattacatctcaataatatatgaagcgtgaaactttattcaataaatatattaaacatttaaaatataattcaattaaaattaaaaatgaagtatagggaaggagaacaagacaacgaggaaagatggaagagaaaatacttggctcaagaaagaaaatgagctgggtgcagtggctgacatctgtaatcccagcacattgtaaggccaaggagttcaagaccagcctgggaaacatagtgagacccatttgttaaaaaagttcagatgtggtggctcacacctgtaattccaacactttgggaggccaaggtgggtggatcgcttgaggtcaggagttcgagaccagtctggccaatgtggtgaaaccccgtctctactacaaatacaaaaattagctgggcatggtgctggaagcctgtaatcccagctacttgggaggctgaggcaggagaattgcttgaacccaagaggtagaagttgcagtgagctgagatcacgcctctgcactccagcctgggtgacagagcaaaactctgtctaaaaaaaaaaaaaaaaaaaaaaattagctggatgttgtggcatgtgcctgtagtcctaactactcaggagcctgaggcagaaggatcagttgagtccaggaggttgaggctacagtgagccaagatggtgccactgcattccagcctggatgacataatgagaacttgtctgaaaaaaaaaaggaaggaaggaagaaaatgaaaaccaaacaagagaagagaggctgattccatgattttcaacacaatagaaatttccattgttctctgagattcccttgggctctggtcttcagaatgttattgttattattattatttcctttagaacttctaatgagcacattgaccattgcttccaggttttcgaattgtcctttgcccttaaactcctcagtggcttgggttttattccaatagagcagaggatatgaaatatttcttggttaatgtttctgggtttgcagtatcagtcagtgaccagagttggattttacgtctaaaaaccatataaactcaagccgagacttgtctgggtgtagacttcccattgccaaatttaattttattatttaaagtcatgttgagaagtcatgtaggtggtctttcttctaagctaggacagacttatcagtctcacttgcctggtactactttatgaggtaaataattaatttgagatattaggcataagctggtcttgatctgttctcaaactccaggtgggtagaaagctcaactgttgacacagggcctggcatgggaaatgattacatgggaagccatgtctgataaccagaaatgatacttcataataacacaaagataatgagagagattgggagtcaggttagtgtgtgaaactagcagtagaccgagagggaaagtgggttgtgatccttctttgaagtcaccacagagtctttctgctccttcacccactatggttagtgaatgaccaaggatactgactttacctcctactattactcaaatgtatatctcttctccgtcatttctcctgttcagttcctctttctctctagcctggtcaattgcaatatctttgtaacatgttttctagactgtaatattgctcctattatccatccttccaactaggaaagtaatattcctgaagtccaaatcatgccatgtccctaccttattagttctctgtgttgagatcagatgaagctataggcagagatgctcttatgacatgaaggactggggttcccttgtaagaccatcagaatttgccctatctaagcccctactcaggagcctagaggaatccctgaactgaatggtctgagtcagctgatactctcagataacagcactttgctcataatatatgaaaacaggagcatgatttagaaaaaaaaaaggaaccaaaatcaccagctaatagatattatgcaataagcacattacagaaacacaaagtcctggtgtacatcaccagggcagtccctgaggacagtctagccaataactacacttaagttgggtctccagatctgattttctaagtttctgatcctggatcctttcataaattatagctgctacctccaatcccaccccaagtctcatgaacaggaaatctgtgaaaaagttttacagggaggtttgagaactccctctgagctagccaatccagagtcttgctttcagccaagcttccatcatacccagattttaatgatgagttatttatgttctcacttaaggaaatcctttcctaccctttggaacttctatttatcttgttattaaaactgtcttcaaatagatttcctgctgcaatacaacacacttggtgactttctcagtcttacaatgggattagatatttagtgctgaaaggatcattgcaaggagagcaatcaggtttcttctcagtgacaactgcttggtcttctttgctgtaaaagaactttgctttgagctttgatacatggaaaatgtctgccagaggccctggtgagaaagagtccgtgtgtctgcccatcttgggtcatacccttgtcatccaggaactaacaagtcaccccagtttacatgcagttggcattggatgggtgtaggcaaatcacctggactatcaaagatacagtgtctaaaaaaggctcacttcctccctatcccaggtggtaacactgcatcgcaagtacagggcatcccaaatacagaacatccctaaccctgcatgcccagggcactgttctcagctctgctggtctgaccaggtagtttcacagaattcttgcttggttaacttgtagttttttgacatgatgtgctagataggtaagatttaggattcttatccatgtaaatgaaacttaaaaagaatttctcctgattgagttgcttagggtttttgtttgtttgtttggtatatatatatatatatataaaggggatgttagggctgtagtcagtggctgattatttgaaaatttcttcaacaatatgggttctgttctgctaattctcagaccaatgagggcctgtgtatgctagcagagagaggaaaagactagggttttcagattaggactctgggccagaatttgttaccatgtgaccttggaccactcatttaaccaaagcttcccagccattccccgtggaaaggaagtggattgaatgacctcccggtagcctcaccgggatattgcggctgcagcagagcaagggctgcatatagaagaggaacatgaagactttttccttacaaagtaaatgatatgaattgactgtggtaaagtttctaaatcagattttttttagtccagagggacagcttttaaaatgagagatttatttaagttataaggaaatatctgtcaaccctcagaaattgcaagatgattattttggttgtgtgtgtgtatgtgtgtgtgtattcctagtggagggtgagagcttgactcttaagaatcatataaaatatcaaattatctcaacttctgataaatagggggaaagacagacattttggggaggttcaaacctctataattctttaggcatttaaccccccaagagcagggactacatttattcattcgtagtgtcctccactccatatcagcatctggcacctaatatgcactccataaatctttgttgtggttgaatgagatcattttccccatgtctttgaaagacagaggcaaaaacagagtgttctcattaatggacagggttttatttcattttctttcccctcccccctccttcctttttgcctgtctgcctgcctgccttccttccttccttctttccttccttcctaccttccttccttcctaccttcttccttccttccttccttcttgcctgcttgcctgcctgcctgcctgcctgtgttaaataatctgaatgatttcaaagaatcaaaaatggctgttcacatttggtagggttctacggagcttatctaacatatttctaaatgagtactgtaacacatctggggccaggcacccaagcctgttcctgtgtactctctcatttgcctagaaaacataaatactgatacaggtcagggaagcaaactcttgagggctgtattaaaattctttttattgcaagcgatgtaaactcaatgaagcaaaaagaagatatttattgaaccagtacaaaaagcgcaagggcatagagattacataccctagagatcactggaagtggaacaagaatggagctaggagtctccttctcctaacactgcctctctctgcttgttttcttcattcacaccacagtctgggtacacagctggtgaagcctcaagatgcggcatagccttgcccttggaagagaactgagagctactctctggttgtaagtgaagaaatcccagcaaaggcttctggttggttaggcttaggccacatgcccacctgggtggccagtgaaacactatggttgggaaaaccttagaatcactgactgtagacgggagggctattcccttaaaggagggatgcctttcctagaaaggagggtgctggataaacaaagtgcatctctaggggtcagggagtagtcatagaaactatggaccaaaagatagcatttgctgaccaagaggccccagtttactcctaaatgttcagagggtgcatttaacttcagtgacttcaatcaattctgtaaattttggtaaacagaaaaaagcagaagaaatagacaaaatagaaaaataacaatataaattatgcaatcaattcagcctgatagtctactcactgagtatatgtcctaaagcaagaatcaggaagataatgaatcgcagttggtctcatttccccccagaacaaacatcttttcctttatctagtactgaaccagaaaagtagagggccgttccagtgctggagggaaactgtgctgggcttatgaagaggcaggtgccaaaatagtgccttcctagaagatttttcaggacagtcttgactatatgtgattttcactgtatacactgatgaattttagaatttaaacatccataaaacacggtgccttttaggctttttgtatgtgcatctgggtgtattattcagaatgaaatctctttactgaatctttcctatttatgagaattgggtggaaatgatcaggacaactaatgagtggatttgtgaggtgtgaggtgtgacaatattgtaacggaagattttgtgttgagcttcttgtgttttaatcatttcttgaaattctgcttgatgctttaatggatgtatttgattatagacacacaagactagcttcttttaggtcatctaattccattgtccagctaatccttacaacccaaaatattatccagagtggaactgaatactccagtaatcagggacacctcccattcaaagcaagcctttgatcttcagataactctgaccattaaaatgatgtcccctgtacattaagcccaaatttgaattcctataatttatactctttgatattatatctctttccagggtcaaagagaaatcatctaatccctctgcctcttggcagcatttcaagactttgaagagaccagtcatgtcgcaacaagtctctctgttatcttcccttgctttattttcaccaactgttgatgatgatgatgataacaacactagtaataacaattaacaataattgggtgcatgttatgtgccaggtgttctaagctatatatatatatactcatacaaatctcataaaaatcctagaaggtattatccccattttacagataaggaaactgaggcccagaaaggttgcataatgtggctcagagaggcgcagagagattagataatgtgctcaaagttatacagctagtgagtaacaaagcctaactttgagctcaggcaattgggctcctgagccttcctttgctaggtgacactactctgagtgtgatccaggttgtccccatttctcttagaataatgtccagaagtggatacaatcctacaggatctgcctgccatgaactattaatgccactcaagttttcattagccacatgctacacctccttctaaacattgacgcaaagaggagctcatccacttccttaacaaatgtggttatacctatgctattttcagtgtgtggagttaattcacatcaagccaatcagatcaatcaccacagctttttccccaatatttgggcagctaaagctagggaccgctatcatagcggagaattctcactgtgtatgagaatcatagtcttctgttgtggtaacgagggaatactatttccatctttggctgtggaatagctttccgtggctgctgctaagctcaggagagttagcaaatcatatgccttcattactatttggttctgtaacaggagtctttttttttaaatcattcatgacctaatctctaatattccctttaagggtttgattaaagttgagtacctttgaaaaaacactgacgtgattaaatatggtggacagaaatctatttacagtcaataagctaataaggcctggggtttcaagagatgtgaagcctgtgtgtatgtatatgtgtgtgtgtgcgcacatatgtgtgtgtgtgcacacatgtgtgttgaaagataaatagacaattttcagaattattttatgatgttgctattacaaacatattagctaactctggaaactggtctaaattgctgggacctaaataaaacatcttagaagacaattatggcattcaagtcagtaagacataatttgctttgttttcaattgttctatacagtcatcctgataacaatattccaaagctgttaagctcacattgcattctatgcaagccaataccactctacttgcacaatagtttcacattttcacacagaaaaataacattgtagaagtggcgacggcaaagtcattgtgccccagtgatgcccatgattaataaaaggtgacgtaggtgattaatcagaagttgtacatgttgccaaatttacagacttgtgggtttcagtatagatcactgtactttataaacctctcattcattcattcaataaacttttaaatgttcacaggcccattaagtactgggaatacaaaaaaacataatcctctactttcaccatgtaatcaacttaatattaccaataatggggattggtaagcaagtcagtgtcataatgtgcctcctgatatgatgcactggcaaggacatgatatcatcttgtggttcctgccaaacatgcttaacctcaatctaatcgtgaggaaacaatcagacaaatccaaatttgggggcaacatattaaacaattaaactcttttaaaatgtcaatgtcttgaaaggaaaaataagaaaaaaaggcagggaactgttggagggtagaaacatgataattaaatacagtgaatgatccctgattggatctttttttttttttaaatgtcattattaggacaacggagaagtttgaatatctagtctatattatatatgaataagtactttattatatgctatatattatatacttatgatattaagtatatattatatactaataaatattatatactaaaaagtaccagtgtagctttttttagtgtgataatgatataattatatgagaatatctttattcttaggagatacataataaggcattaagaggtaaaatgtcatgcctaaagcttacttttaaatggttctgttggccggaacagtgcctagggcactgttctcagctctgctggtctaagctctgaccaggttgcttctcagaattcttgtttggggcagtggctcacacctgtagtcccagcactttgggagcctgaggcaggccattcacctgaggtcaggagttcaagaccagcctggccagcatggtgaaatcccatctctactaaaaatacaaaaaattagccaggtgttgtgcctgtaatcccagctactcaggaggctgagacaggagaatcgcttgaacctgggaggcagaggttgcagtgagctaatatcgtgccattgcactccagctggggcaacaaagtgagactctgtctcaaataaaaataaaaataaaagtaaatgctttagtaaaaaagagattatatatggctatagtaatagctatattaacatatcttttatatttcacattatacatacattttctattaatgtctatatgagcatctatattgtgtgtctattatatctcactacatatggctatactattagtttcctagggctaccagaacacattctcacaaaccaggtagctaaaaacaaaagaagttattctctcacagttctggaggcttgaagtctgaaatcagggtggtggcagggccatgctccctgcaaagcctgtaggagaggaacttccccagtgtcctccagcttctggtagttgccagcactccttgtcattcctcggcttgtagttgcatcacttcaagctttgcctccatcttcatgggacattctctctgtgtgtctctgtctaaacttctttctttttataaggaccccacttactggattaaggcccatccgagttctatgtgacctcatcttaacttgattgtatctgcaaagacccaatttccaagtaaggctgtattcccaggtactgagtagacctgaatttgggggacactgttcaacccagtaaggtatataaagatattacagagggagagggagggtgtataggatgggagcatgtacaatgtagcaaaatattaatagatgatggattttggtgaaaggtaggtgactgttcattttgcccttctttcaatgattctaaagtttgaaatatttccaaataaaattaaaatttggggaaaatatactatatcaaaagaagacattgcctttgttcttcaggctatgtcgaagttatggaggacactggagcaaatgcctcatgatgatagcactgcagggccctgcaggaacagggaagacagcagacagtgccaactgtgcttgggaacattaggaagcgtttccatgagcagtgacagccggttgaacagagttttgaaggatagtgtcagagtcagcagcagggatgcaggtgcatctggggagctgccagttggccagaatagttggaacaaggggcgtgtgtgtgtgacaatggtggtgccgaggctggagagaggcaggaagcctgtcatccaggacgctgcaccatgaagactgggggagctgtggcagaactttaagcaaggtgtaacctgagcaaagttttgtgtgagggctggggctatgaagaagcctgaagacaaactaattggaagactggtgggacaagcggacaagccagaggagaaacaaggcaaagaagagtagaaagagagtgcaatagttagcaggaggtagagggtccgggcaaatgtttgtttttataagaagagagaaacgtaagcatctgtatatgccgaggaagaagagtcagcagatggggcagattgcagatccaggagagcagagatgatgaaggaagcaagtcctgggacatgggacccagaacacaatgggaaagagccctatttctactgggatgttgaggcaggggactggagagaggggaggcgtaggcctcagatcttctcaggacctcatgaagaacaagggagaggggaacagtgaccaggcaggggcagaaccgtggaagactgactggggtggacaggagaaaggaagagagtgagcccaaaggaggcgaaaacagggttactggtgagggaattgggaagcaaaatgatgagtcttggttcgaatgttatcgactcagggatcagtatcctgccttaattaacaaaacagggtttctccctgctgcatcctccaggcacacctggatggggcatgttaggtttcaccatcaacccttacaagggctgcttcaatagatttgtgcccaggattcccagaaaacaggtttccatgaatgccactgatacagagagttgggttagtgggtaccccttcaccctgcccccaagagctttttatgttagtttatgaaagggaaggacgtccgtcatgccattccatttaactgttaactatccaggggttacggtaacacacaaggctgatgagatgtgtaggctcaaaaacagagcaggccaaaggtaggcatgccaggacctagggctgaaatgatttcctctatcatgtggacataagtttccatttttctggaataaatgcccagaagagtgcaattgctagatcatatgttttgaaagaaactaccaaactatcttccagagtgtctataacattttacattcccaccagcaatgtatgagagatcaagtttctccatatcttgctagcatttggtatttgtattagtctgttcttatgctgctctaaagaactgcccaagactgggtaatttataaaggaaagaggtttaattgactcacagttccaaattgctggggaggcctcaggaaacttacagtcatggtggaaggcaaaggagaagcaggcaccttcttcacagggtgacaggacagagtgagtgcaagcaagggaaatgccagacacttataaaaccatcagatctcgtgagactcactcactgtcatgagaacatcatgggggaaaccacccccatgatctaattatctccacctggtcccacccttgacacatggggattatggggattacaattcaaaatgagattttgggtggggacacagccaaaccatatcagtattattactatttcttttaatcttagtgattctaacaggtatgtaatgacatctcaatgtggtgttaacatgcattgccctaatggctagtgatgctgaacatcatttcatgcacttatttaccatgatgtaacctctgcagttggatgtctcctcatgtttttgcccattttcaaattagattgtttttttcttaatgcaaagatttttaaagccttttagtaacattcttagaggcttttaaaaatcattcttccaagtacagaatatattttaattcagctctcagtagcagggtgttaactctaaacccatcattgcctcagcatggatgcaggatccaatcctctgttattcagcacgggcattttccccacatgtcacattcaaaaaacactgctacatcctcatctctttcccagccattacctgaactttacccctgagctagaatctccagagaagcttgaactttagcttctagagttgctcctgacctcatactttgctattgcaccactaagctgaaaccaagagttgaaaccaagctttgggaattatacctctttttctggatccacatgccctgtgatataaaaataaatgtcggccaggtgcggtggctcatgcctgtaatcccagcgttttgggaggccaaggcaggtggatcacctgaggtcaagattcaagaccagcctggccaagatggtgaaaccccatctctactaaaaatacaaaaattagctgggcgtggtggcaggtgcctgtaatcccagctactcgggaggctgaggcaggagaattgcttgaacctggcaggcagaggttgccatgagctgagatcgtgcactgcactccagcctgggcaacagaatgagactccatctcaaaagaaaaaaataaaaaataaatgtcagtgtgttcctttgtacttgttcccctgtgcgccagccagtttgtaatttgtctcctaacccaaaaggcaaagagtaaatgggaaagagtaggaacttgaaaatgtgactccctaaagacagtgggtcccctttgaacatcattaatttgcaggcataggaaggaaataaaagaatgtggaagagaacgtctacaggaggaagtcttgggtacactgtacaccacatgggacatagccttccctaacgtactgagagtctctggcaggttatttttaactgccacattgtcaagtaaatgtttgcactttgataagtgtcctgtccactggcttgttctaaactctggtctgggagcttaccagaagagcctaggagtggtatgcaagagagagagcctggatgagtgaaatataataattgtttagctgccagccctgatgtctatgacagatcaaacaatccacttgcattgtgtttcactgcttgcatcacctggtcatgagttttcagtggaatttgtggaatggattgttctcacggagtcacccaatatccctgaacaatggtagcatacattcttagttttatataagagctaataaggaatgttccagccacccgatcggaggcagagagctgttgctgatgcttgcctactttctttctttctttcacactctccctttctccttctcctgtctgaaggaagaaagaagggggcaggcagggaaggaaaaaagatccattatgtagaggtcactagaagagtgacaccacaggttggagggaagataaatatgaaatatggaaaataaggggtactctgtggtttttcccttcataaaatttgcttttatttatttattggttcttcctcagtgaataaccttctagaaaaaggcatcaggctgggcgcggtggctcatgcctgtaatcccagcactttgagaggccaaggcggccggattgcctgaggtcaggagtttgagaccagcctggccaacatggtgaaaccccgtctctactaaaaatacaaaaattagtttggcatagtggcgcatgcctgtaatcccagctactcgggaggctgaggtgggagaattgcttgaacccgggaggtagaggttgcagtaagccgagatcgtgccactgcactccagcctgtaacgtttcaggagtgctttttgttgcatgtaacagaaaactaactccaactgggtaaaacaaaaaaagagattgattaattaagcactgcaaaatttagaagtagtggtttcggtgttggtttgatttagtaacttgtcattttttctttaccttttatggtgtccatttcaaaggaaggctggctccatgcttcagggtttgtttccaaaaacaggcaagtccttttcacaactcgtggagacttgttcttaatactggatggatcgcccatgaccagccctgctggccagagaaatgtcacgtgcagattggctggggcttggctttcctgaaccaatccccacagctggtggtggaagggccctgttgatttagacgccaaggttcttcacaagggagggtgaatggatattggggcaacaactgcaatgcctactactacatcttcttaaaaagttattctaatttctgcactgatgattaaaatcctttaagagagcatcaagcctctcattctgaaacttgagataaaatggaaatagtaacagtgaattaatttacactgaaacatgttgcaggaataaatttttacaatcacatttgtcaagtgagccaagaagtaattttatttctctataattgaattagattaacttattatccccaatttctacttggtaatagaaaactatatctttctaattcaagataaatccaattacttcttgtttagaactcagtcaacttagtctttctttctttccttcttcttcttcttcttcttttttttttttttttgagacagggtcttcctatgtcctatgttgcccaggatgtacttgaactcttgggctcaagcaaatcatcctgcctcagcttcctaagtagcttgggactataggcttgctcatgctcagcaaaagccagtctttcttcagtaaattcttagtcaatataggacttctctcctttatctttctttctttcttttttttttttttgaggcagagttttactcttgttgcccaggctggagtgcaatggcacaatcctggctcactgcaacctctaccttctacctcccgggttcaagcgattctcctgcctcagtctccccagtagctgggattataggcatgtgccaccacgcctagctaatttttgtatttattagtagagatggggtttcaccatgttggccaggttcatcttgaactcctgacctcaggtgatccacccaccttggcctcccaaagtgctgggattacaggtgtgggccactgtgcccggtcttcctctccctattcttccaatcttcacttgaagaatgatcttggttcctgtggttcctacatatgatcttgacattaatgggtgggcaactgtgacgtcttccttgtgaggaggcctcctctgagatggctttggctttaggtatctatcctcactgccatctgccgctgatgttcacagtctaaacttgccccggtctatgcaaccataaggacattcccagtccattggatttctctcagccaaactattgttggagctcatggggaaggatgtcggggaaaccatgggaaaaattcagatgcccttctgtgctactaggatgtttctggaaacatggaggtggagatggtgggtctctcttagatagtttctctggctggacctgccctgtggccattgctactctactgtagtcacttatgttggcttagggctctccatgagaatatctttttgtaggattctttttttttttctgagacagagtctcgctctgttgcccaggctggagtgcagtggtgccatctcggctcactgcaagctccacctcccgagttcacaccgttctcttgcctcagcctcccgaatagctgggactacaggctcccgccaccacacccagctaattttttgtgtatatatatattttagtagacacggggtttcaccatgttagccaggatggtctcgatctcctgacctcgtgatccacctgcctcggcctcccaaagtgctggggttacaggcatgagccaccgagcccagcctgtaggatttttgatggagagtggaggcataggccctcctgctccaagatccccaaacccatctgaggtttctattacccctacgtacaggactggactttccaagagctaccccgacttattctcttgctctatttcccacttctcctgctttgcttccagtccagcgaagattttttaaaaatcgtcactgtctagtctggggaggggagcttatataattttgcattcttttgaatctcttagttatggcataaatcctgctatttagtagttttgttctagggctggactccagtcatgtgatttggagtgattttctcagctttagcaatacagaaattgaatagcatggtatgttcaagctttgcttcttattaattttgtttgtagaaatacactgggcacaatttgtgctgggggtcctgatctagttctcttgaagtgttcagtaatatgcggagatctactattcacttttcttcagagattctcatttttaacattgaaaagaaatggtcttgtctgaaaagcttttgcttgccacgcatatggaaacgcatttaggaataaatgactactgtttctgctgtttcggcaatgggttattgtgataacacagagattaacaacatgttggataaacattggtaaagcccagctgtatacttttagggcatggttttggaacttcatgttcatttctctttatctgtggggtatctgcttcatgaagtggtacctacaagtttagagcttgtagaacaaagccttgatcagctgctgtgatggccatgtcacagccacagcttcatttttcatcctccagggtcttgttaatctccttcagtgcttaaccgagagtaattccattgaaatgggttggagttcccttagaattaaaactcttatgtgtattggtctgctatctttagtctatttcattgcctttcctcttttctgagcagatattggatctaaggttctaggtgaagaagcaatgaacactcataagatgaaaagtataacttggaggaagaaaccccagggaaaggttttgtctccaggtaaatggacagatcacatgagatctttaattcccgtgcctgtacaagcttccataaatggaacatgtagcagagaggaccagattgacaagaagcactcagaagagaagcctgtgcctccatcctgtggctggctggggaccatcacacacgggaggctgtgtgctgaggaatgggtgtttggaggaatatcctcctaaccagcttttcagtggactcagatgtataaaaagaaaaagttgccaaggactgtacttgctttcccagattgtcctagggtacattgcattagcctaaaatggcaaccctctatcttcctagtgtaataataatagcagtgctgtttgcttggctctgtgatttctacccttaaaacccttgcactcagtgtacatatagcagaaacttcttacagtataaccagtaagattataggatttctattaatacattagtcaaatggtaaccctaaaagcactgaacattgaaaatacaatccaataggataacccagtaacgtgagcatttgtcctgtgtcccaacaccagcatcacaaagcgactcagccatagtcactctccaaataaaaaaatatataaattcatcctgtggagctgtgcgtgagaattttacaacattacacaaattgatggtgcccctcagtataaagagcacagtctttgtagacacagccttgggtttagcctcacactggtgactttcttaaccctggcaaggtaattaaccctatccaaaccagagctttccatctagtgcaccacgaagggtttacagatgtgctgagagactggtcctctcagttcttgaggaggtacttgctgtgatgtgaaaaagactagaaacatcatcatcatctcagtttcttcatctgtcagtcataattgtatttttctcatggggttgctataaggaataaatattgatctctgcaaggtgttcagcacagcacttagtaagtgattaccaaatgacagtatgtctagtctatacagtcctcagccaaccagtcactttggccagcatttggaaaatgtctgaaagataattaattccaaactattgcacaaagagaatcctgaaagtcgtgagcaaggccatcaaacaagtaattccactccagaaaagtcaggccatcctagatttaatataatgatggccattggaacaaattctagctttgcctgccaagttgctcttttttttttttttttatactttaagttccagggtacatgtgcacaacgtgcaggtttgttacatatgtatacatgtgccatgttggtgtgctgcacccattaactcgtcatttacattaggtatatctcctaatgctatccctcccccctccccccatcccatgacaggccctggtgtctgatgttccccttcctgtgaccaagtgttctcattgttcaattcccacctatgagtgagaacatgctgtgttttgttttttgtccctgcaatagtttgctgagaatgatggtttccagcttcatccatgtccctaaaaatatggaacgcttcacgaatttgcgtgtcatccttgcgtgggggccatgttatcttctctgtaacattccaattttagtatatgtgctgctgaagcgagcaccaagttgctctttaaggcatccttctttcacagtaagtagctagaaaagtatgaatgcttcggttccctattccactgaaaataaaatgatttcctcaaatttgagagctgttacaatttgtttccaatatacagtggtacccctgatccacaggggagacattccaagacccccattgggtgccagaaaccatggacagtaccgaatccaattgtcatcagttggaacacatttctgtttgtgcctttcacccaaaacttaatgccttttccatcttaactcaacacttatcacacactgtggccataacttttgcagttggaggtgtgatagcaaaactagcataaatttgtttttccatcttcccaatttcatggatagatttattcttactgtagattttagcaacctcagcgtacatttttttttctaaagtcaagaacttccacttttttacttcaccatactttatgtacggtttctctctggtgtatctgagagcatcaccaatgctctggtgattgccagcatcactactcctacactttagaaccattattaagtaaaataaggggtacttgaacacaagcactgtgatactgcaacagtcaatccgataactgtgacagctgctgactaatggacaggtggcgtctatagtgtggatacactggacaaagggaggattcacttccctgggcccagtggagttgcacagtgcaagatttcataattctactcagaacagtgcagaatttaaaactgatgcattgtttatttctggaattttccattgaatatttttggaccatggttgactgaggatgattaaaactacagaatgcaaaaccattaataagggggaatcagggcccagattattatttgtcctcatatagctgggtcttgatgagctatcattttattttgttttacctctgggtgccctgggcacagttccctattctgtgcctactctggggacacatatattaggatcagaggtggcaagactatctgtaaaaggaaattgaaaagacatttaaaaacctaaaggaagattagtgatttcccagagaaactcaatggcagatgtcactggaatcaagaaccattgctctcatgcctggaaaacctgtttccaaaatgttcccttttgctgccaagggatcagctgctccagtagctcagcatcttggcaattgtgggaagaggacagaggtgaagaatctctgggcttattagacatgaccttagagaacactgatgtgggaaagcagagaatgaacttacaatgagtgcaggatgtttgaaagcaatacactatgaaaatgtttcatattttaaaaactaagtaataagcatgtaaaacactaccttctctcctaaaccaaatcagctgtttggatgtaaaaaataataaccaaatagtaaatgcacttaattttttaaaaggagtttgctgggaagctattaatgaaatagaaattgaggaagtcttactcaagctgcgttttgtttttggaactgcagaacacactcccgtgtctcgagtagtgtctgagaacacagaaatgggaatctgaatactgggtttccaataactgctttgcaaatatttagctctatgaccctgggtaggacaaagacaatcttgatgcatcattccacacctgtaaaattattatttataaggttcaagagtctatggcatgaaattcagagactcgggggtccaataaagagattatgtatgaaaagacctggcccagtgcctggtatgcagtaggcatgccatgaggtagccttctggtgtgtgtgtaaagcacaaacccccaagatttcagggctgagtggagccttatgggttattccatattttctatttgtctttgtatgtttccattctgacccattgtgcatcgattttaaagattaaactctcataaaacaacctcatgttctgcatttctaagctattgggggcagatgggaccttcattgaaacccccaagtccaaacatatgtgtttaccatggtcacagcctactatgtggcggataaattgtctgtttagttgtctatgtcccttgaccaagaatttcttgacatacagggactcccactttttgagctccgtagcacatctgatgcaaagcagttgctcgatatatatttattgttgtcattgaccattaaacatacaaaaaaagtagtctgattgaattgaatttagacgtacgtgaagaaataataagttaccagaagagtggtgtcctggttgaaatgggacacataagggcaagcacttgccattgtcacccagcccttcagggtaagcagcatccttagcccacagtttctcatcatgatcacaagagaaatgcaatctctgatgggtactctacccattgtcctgggcctacctatccacagatctattcctgcacctttcccagaaggctaacccctgcaggctatactcagtctccctagtcaactgacttcaaaaaggagaaattggcacttaacatgacacaagctctgctgtcctctttttgacttcctcttaaggaccatggaaaagatttactccccagatccatttttgcatgataattaaagggcccttgtagcaaatggactaagagcttcccaggtccagctcaataccccttccttccaaaagatcatcctattcctgcctggcctcagtggttactctctggtctgaacacacatagcacttccagtttctaattcatgtttaatacttgaaatctactaccttgcattgctatttatcttttttgtaggcctttccttttcaactagactataagagagtagactccattaactacatgttttgtatccgctaggcctagcacacagtaggtactgaaaataccagttttttataatggtactgatgaagaaaagtaccattcccactggatgttgttagccattgggagggctgtgcctaatggactttgaagttcacctgagcctgaattctgattcttcccccatatttgatatttaacttggggcaaattatttccattcctctttgaaaatgggagcaattctctcttaggattatttggataaaatttattaactttagactgattagcaccagggaaacaatcccaactggaagttatggtgatcttgatgacaataataatacttaaggggctgctgcataatatcctgaccaacatttcatcccaaatttccactgtaggaagtagaaaccagatgtgcccaaacattttaaaacagctattttattgaagtaatttcatgtttatggaaaaccagcctgcaatagaaatcagcccctcacttatggttcacggtcacttgatgaatggcccatcatcataaaataagcagggagtttggctgggagccatgccacaaccattttattggaatgactttgttgtcactgcatccccacactcatctctctcctacagcacagttttgagtgattgaagttagtttgggcaagaattccagacagggaaaagcaaataagtgtgtcaggaggtcaaaagagaagaataagccacaggcggaggaagaaatgcggagctgataattgaaagataatggatgtaggggtgggttacagcaacacagtgggagggggatccagacccagcgctttctcaggcatctgagcgagacccagggttacaactcatcttacaagatctatgaagcatggatttcaaaatatttgggccacccagtatggaatttgggcaaatggcactattgaataaagccattgacaaattactttcctttcatttccttcactggcaggatcttctgtttatgcctcctgagatgcaaaactggaaggagtaaatttgctgacaagtatccatgtgcagggacagttgatggaatttttatcatgcaaaaatagtcttggatgatgggttgagagattgccaggaatctctggaatctaaccctcagctgagcatatagaggtttcattttaaggtggtatcaaggtgaagaacttataaaactaagctgtattgattttttttctttgcaaatgtttgaattttgtaataggcattcattcccagcgaaatcttaactaaataggaggctggaaatctgtgacgtagtggaccaaggttaggttttaaaggtaggactttttaatcagacagctgactctagaggtttatacaagatcataactttaatccctccatgcccctgttgtcttatctgtaaaataaatataataatcatcatcccaaaggttataagaattaaagcaaattataaaggaagtagcccctggccttaggagaccctcaaagtttaaatgtcctttttcttttcacttctctctcttattttaactccttcctatccagctccagcaattttctctgattttctgtgtatctgatggaaacagcctttgctgaacttataaataatgcaggcaaggctgggcgtgatggctcacacctgtaatcccagcactttgggaggctgaggtgggcagatcacctgaggtcaggagtttgagaccagcctggcaaacatggtgaaaccccatctgtactaaaaatacaaaaattacccaggtgtggtggcaggagcctgtaatcccagctactcgggaggctgaggcaggagaatcacttgaacccgagagccagaagttgcagtgagccgagatcgcaccactgtactccagcctgggtgacagagcgagactccatctcaaaaataataataataatgcaagcaacatgaaagagaaaaggaagtgagccatgtagctactgagagggaggtatttcaaagaaagagctcatcaagtgcaaagaccacacagtagatgtgtacatggacatttcagaaaatctcaaggaagccagggtggctgaagtagaccaatcccaaggaagtatggtaggagaagaggtctaggagatccagaggggcagagtgtatgattgcctagggccttgaaggccagtaaaagtacttgagcttttactctaagtgggttggggagctgctagatggttctaaactgaggagtgatgtgttttgaaatgattctcctgactgctatgttgagaatatgttatagggcaaggatgtggaatgaggaggagagggacacataggcagaacagggacaccagttaggatcccactaaataacccaggcaggaggtcagagtaggtcagtagcagtgtaggtcatgagaagtcattagaaaaggtagagcaatttaggctttgctgatgggttcaatatataatgtgagagagatccctttaagatttttggtgtttatgaaggtgctttttagtgtaggtagttgttaaattggtgccctcacagggggcattgggggatgatgggtggagccttctattctgccgccttgctccaccccaagtcagtagtgtttttttagggcatgataaattgaatattctaaaggtgattatggtgatggttctacaactctgtgaatatactaaaaaccatttaattgtacattttatcttattttatttttgagacggagtctccctctgttgcccaggctggagtgcagtggcatgatctctgctcactgcaacctctgcctcctagattcaagcaattttcctgcctcagcctcctgagtagttgggattacaggcatgcaccaccactcccagctaattttcatatttttagtagagccagggtttcaccaggctggtctcgaactcttgacctcaggtgatctgcccgcctgagcctcccaaagtgctgggattacaggcgtgagccactgcaaccagcctgaattgtacattttaaaaggggaaactttatggtatgtaaattacatctcaataaagctgttggaaaaaaagaaaaggaggaggtggtcagagactgagatgcttaaaattgagattagggaagatttccacattggcaataacaagagctagagtctgaccatggaagttgagtagccaagatggcttggaggaggagtcaaggaagacagaggcccaagtactggaaggacatctgtgaggatatgggtgtcactaagaatggtggcaaaagtcatgttggtgagaggtctgacagtgagctggggggaaaatcttcaccaagtcaggagtgacctgagagtttgcagatgactacaacaaggaagcatggcaggtaggaatctgatagcaggatgttccaactgggtgtgggtagaaaaaatgttctgaaatttgaatattggtgaaggacttaaaaaaaacttcaagtattaagggcctactctacttttcctttattaattaattcattcatgcaacatgtatttgttcttttggggacaccattatctactcatttggccatatctgcagatgctcccaaacatggtggagctggcttttgatggccagaatcccagattctgttataataatctcctttcaatgagttccccaaggacctattacccactagtatagtggagggctgttctgatcagtatgcagcctttccttgatcactgtcatcatattggccatcattgtttagttacactaatatagtatatggctttatgtttcttaggctgtagggagctgcctgttttagaattagatggaagaagttgtgataagctttgcctttggacagatctgggtttaaatcttagctctgctatttataacttcataacttcgggaaacttaatattgctgagtcttagtttcttatctacaaaatatttacctcataaatattggtgagaattaaataacatgtgtgtgtcaaactccaaacagatagtaggcacaaccagagatgttagttctctttcctttcccttgttttccttccttcacctttatgttaatgttgcttctgctattttatttctagcttctatcatgtccagggtctgggttctgatcagaagccttcctctagggatggttgaaattatcaagccaacttccagattggcatagagtcactctgattgtttactttagtgtgccatgttatgcttctcaaggtgttttataaaatgtttctaatcttactctttaatactgtgaggtatataagtgaggcattagtattcctaatttatggaagagaatataagatactgaaagtagctaacatttattgggcatttattaaatatcatttttctaaatgttttacatccattaactaacttaatcctcgcagcaattctatgaaataggtattattaactttatctcacaggaagggaaacaggcacagagaggtcaaataatgtgttgaaggtcacataacttctaagcatgggggccagatttgaacccaggcagtctggttacaaaacttaaccaatatatggcctctaatgtaagacaagtaaacaaattgtgtgggggttgcaagtgaagaaatccttttaccagttactgctcaggtatctttctggcctctgagatggagtttcgctctttcacccaggctggagtgcagtggttcaatctcagctcactgcaacttccatcttccgggttcaagccattcttctgcctcagccttccaagtagctggtattacaggggtgcggcaccatgcccggctaattttcgtatttttagctgagacagggtttcgccatgttggcctggctggtcttgaactcctgacctgaggtgatccacccacttcagactcccaaaatgctgggattacaggcgtgagccacagcacccggcctggcctctggaatctgatggagatggaaaatgttggtagctcactgtggtcactaatagaacactattgttatcttcagcaggagggaggcattccatacctcctgcatgagttttattaccctgtttccttctagctcagccacccttgagaattcttttgctgagacaaacaagacaatccctctgagatagtagcaataattgccacccttgtcctattttagttctgcttgttgcaagccaagttctaatattaaagccagtactaaaaaatcataaactttctcaatatcataagtctaaacacgtaggggaagctttggaaaactttaggaaacaaataattcatgaggtcaaaatcaatctcataatgaacaagtagatttttttctttggaagcggaagaatatctggcctaagatcgaaccattggacactcatgaaacttatcttagaacagtgaaactatctagtcagtcacattgtggattatttactaagtgctagaaatctcatagttaaagcatttcatcaggagtagatgatcaaatatttaaaatatcaagagatttgttatttttcttcttgctggcactgatttagtttctaaccactagaatttctcccagaccaggagtagggaaaaaaagagaagagaaaactaaagcctaactattttagtatgttaataactttgatatgaatctgatgaagaaagagttgaaaattattagctaaaatgagatagggcatgtgtgtgcctatatgtatatttaactattgccctgtgagccctattctatttgaattggcaataaaaagtggacttaccttatatacttgtaaaatgcatgaaatacatatacaatttgttgacttatttattttctaaagactcagtctctccactgatgtagttactgaaaagaagttctcttttccttatttgtaaaacgttttacatatacatcccctatatgtacgttataatagatgttctacacagatatgcatattgcatatacatattatgtttccatgaataaatacagcagaatttcagtctaaggaatgaaaagattatgacttaaacataaaccaactggagcaattcaaagggtctttcttaagaacatggaataaacgtgctaagatggctgaaattatttaaagaattaggtaaaatatacataaattcctttaaatttaaagaaaatttttaaaattaaataaaatataaatgaatgcctcagtctttgatctgaatgcagcagaaaaaggggattgaggcatggctgggggccagctagccttggcctcttgctctctgaatggccctggtccatcccctctttgaagctgagtagagttcactgggctgaggcatacaataacggcaggggcttggggaattcataagagggaaaaaagtcgcactgcactttctgagaaggccgggattcacatatgtgggcgcacacacacacacacacacacacaccaggaaatggagagtattgcccttgtcacagaataggcattcttatggcccctccacacatttcaagagactttgagaaactagtttggggctggaactgtctcccatgccctttctaagatctgagagcccagtgcccaatttaggagagttcaaacaccaggaacacaaaagactcaatttggagtgcagcggcctcttgtctgtcaatcctgtttgctgaacctgctcctccttcagggtactaaaacgggatggagcagaggaaggactgggatcaaggataggagtcctctatgatggtgctcattctccctccataaggagcagatgttacttctcttgaggatgtgttatttcatttcctacctccccctacaaacaattgtgatgaggaggaggaggaggaggatggtgataaaggccaacagcatttattgatccctgactgttgggtattatgctaagctttacattcatcaccacagtctactttcattccctcaataatccccagcagtaggtgccaatatcctcaccatagtctactttcattctctcaatattccccagcagtaggtgccattatcctcaccttccctgtttctctggaaaataaactgaggcttagaggaaagaattaacttgcttaaggtcacacagctagtaagtggttatggtaggtagaataatctccagagatgtccacctcctagtccatgtgactatgttgtgttacgtgccatgggaaataaaggttgcagatggaattaaggttgttaatcagctgacctctagattggggagattctcctagattatcttattgggccaaatataatcacaaagatcctcataaatgaaagaagcaggagagtcagtgtcaaaatggcacagagtgagagagacttgatggccattgctggctttgaagatgaaagaagccgtaagttaggtctgtggaaggctctggaagctagaaaaggaaaggaaaccaattctaccctggaatctccagaaaagaacacagctagctgacaccttggttttaggctagtgagtcccattttggacttctgacctccagaactgtaaaatactaaatttgtgttgctttaagccggtaggtttgcagtgatttgttacagcaaccagaggaaactaatacagtggtaaagctgaagcctgaagtctggccctagaccttctggtacagagctgtgccttgctccttatagtgcaggccttggtagaaaggaatagaccactctgctgaacagctccaccagacaggcccaaaggcctaagagacacaaaacagatcatgaacactccaggaatggcagacattctgtccccatccagccagggaatggtggggtggggtgagcaagttctcttcaaaacgctgaatccctgggaccatggcatttccccactgatcacattcattctgtctggtccttcaaggaggtaacagactagtggggggcacagtcaaggtaaacagataagtacctttccatgggatagtgctatgatagagtttatggaaaagcatagaagaggcatgctaccagtttcaggggcttcaggagggctccctagggaaggtgatcactgaactgagtcttgaaaggtgagttagggggttgtgaggctgagggtggtagaggaggaagctgcacctggaaagtcctggaggtatatgagagtgtggaaagtcctggaggtatacgagcgtgtggcttacccaaaagctgcacatggatttgacaggactaattgagtttttatttgtttgtttcatcctatcactggtaagacaatatttgtatcagtcagaagataccaggttaggctacagtaacaaacaaccccaaatctcgtggcttaaaccacaggtttatttcatgctcattctacatgtccatgatgtgtctgcagggcagcagctcgttttagtttcccagtgaccctagcttacagagtggtcatcatctcaaacattatcagtcaccatgccagagggaaaggaaactctgaaggatctctgcctggagatgacacgtgttttttctgctcaaaatatgctgacaagaaatgtttcatggctctacccaactgcaagtggcccagcctagaactcaatgaaaaaaagcatttcctctgaagccaaggtggagagccaggaatacttgttgaacagaattaatgaccagcactgtgtttgttagccattttgtgtgtgacactgttcaaccaaacaccaagcaatttagaaagactggtatttaccttcttagacttcttattagccactagtgccctaagtcttctctaatcgtggatttcaataccattatcctcactgttccacaacaacttcctgtttttatattatgcacccatgacttttctaagaaagcatgtttctagtttgcttttgccatcaagaatcttagagccaaatttgcactatagtacgttccaggtagcccttattatctgcaaacagttggtaccagaaaaagtctgtctaagggaatccattgtaaaacagggagcaaaatatgatgttagattatgcagagttgaaaaacaaaacaaatgagtatgaaaataaatttacttaattttacttttaaaacacttatatcacattgcaaccacgtgctaattctcagcatgaaaaattaaccatgttgactttttgggtcccactttcctcaaaaaattttaagatagctcaatggctttttttttttttttttttttttttttgatgcagagtctcactctgtggcccaggctggggtatagtggcacaatctcggctcactgcagcctctagctcccaggttcaagtgatcctcctgcctcagcctcctggcttttttttgttttgttttgtttttgtatttttagtaaagatagggtttcgccatgttggccagtctggtgttgaacttctggcctaaagtgatctgcccacctcagcctcccaaagtgctgggattacaggcgtgagccactgcacctggctggtttattctttatatattgcctcttttgagagatattctagttaactatgcaatggatttgcattctatttgctagttgtattggttgtttgcaatcccacagcatagacgttgatggaacagcaggaaattggagctggtgctaaactgcagaatctgttagagcggggccttcttttacagctggtctcttcactagtgaatatttctgaattaggaagactttgcctccctatgaaaccctgtaactgtggagacctggataataaatacctagatagagaatgagaatccccatgtgtggaatgcatttcttggaattaatcttgtccttggcttttattttatcacttttttcctttttgttcagattccctctactattttctttttttcttttttttttctttttttgtatttttaaggagttgcctcagatcttttctaacaggaggcagggtataaaccaacaatggacataaatattgactacccaactttttaattatccccaaacttgttttttcagaatcggccaccttggggtagatggggtctgtgaacttttcttaaggcactgagcggagttgagtggctgaagatgcttcagtgaagcttgatgtttatcctacccttgtggtcagctccttcctcccagggagctgtaaatcaagaactgtgggtgtttcttgattttccggtgctgcagctcatttggatggtccatagggtgtcactgggtaacttcctgctctgggacctctctctgaaatagaaacttccctccaaaggagagactgtctcctatttcatttataaatcaagttaactctggttctttgactttaagaaaataacctatctcctcctctcagcaaatttcttcctcttggtctcatgcatgcagttgctaacacatgtattcttgtggtggaaacagtagaaaagtattaaacctttaaaataaaaccacaaaaccctgcaattcatgaaacaaacctctatggagtctttgctctttgtaagggactttccgtgtgtttgttcatgcaatccttacaccaaccctatgtggttagtcttattgttcccatattaggtgtaggagatggatgctcgaagaaggtgcaaatttcgcccaagatcacctagtattggaagtgggatttatacctatgttggtctgactgcagagctgcccatctttatacacctcaccactgtctcacctcttttcttatgcttcccagccaggttataaaacttggaaaagaatagcatacctcctatctagaaaataacaaaagaaagtcattctgtaatttctaaataatactaagtgttacatatgtattttaatttaaataaaactatggaattttccctgatggtcatcttaagtgtgagaaacacacattttcacttgtcagggtggtcttatagtaatgcagagcaaacaacattatctatattttatagatgagagacccatccagggtcctgcagataaaagggccagagttgggattagagcacaggattcctgactcctaacccagtttactttcttctactacaatataccccatttacgaccccaaataggaatgttcaacagtataaatgtaatgatttaggatgagatgagaggtagatgggaagaacaggaggaatcacctctgtaccctgtggcactcattgcaacccatggaaatgtttctgttttaaagtccagcatttagttctggtgccaaaacaatgctgagtaatttcgtagaacctgagaaccagagaaggatcctgggaggaactttttgtttatttgactttatttcattggcctcactttatgttcttttcaaaaccaagaatgcccactgggttgtgagtaatgacaatttccagacaatagaaaataatgcccaaacggctttgtttgagagattcttgacgtcttttgttatccacctacctttttatctctacattttgctcattgcttccatacaattatcgcacttatagagagcatatttttcctcaaaccgccaacttcacaaaacagcaaatgatttgtaggttatgttgcattaactgtgagtgactgaagtgcccctcaatcacatacccctgcctttatcttcatctaggaatgaaagtagccaggaaaggcaaagaaatcattcaagaatttaaacataaaaagttggctaaattctgctgtggtagacttctaccggatgagtttaatgttaattaaaactccaagtggagttgtttgtaaatgaatcattccctgttcagtttgatgtagcaaggtcagcttcctgctccaccggcagtgcgtgccagctctttttctcatgtgtaagctgtgaatgctgttaagcctgtaaaccactataataggttcagagattttaggatccctgaaagagaaggatcagaacacagcagtgttgagtgtcaggtttcttgggcacttgaaggattaggcaggacaagtgaagtgttactttagggacaaatgtctgggcgattctcaggcagcaggctggagaatgtgggctctgaggttagtcttgaattctaatcccagctctattgttttactgactgtgcaacatggagcaagtcattgccttcttctgagccttggtattctcatttctataaaaatacaattataataaccttattgtgttgttgtgacaatttgatgcgataaagttactggaacacacgaagccctcaacatctggttgcaatcatgatgataattaatgtatctatgcaataaatagtgggcactgctatgtgctccatgctgttctgggcgtcggggatacagcagtaaacaagacagacacaaatccctgccttcgtggggctgacattccagtagaggacagacaataagcaagatacgtaagtaaaaaatagagttcatggccaggcgcggcggctcatgcctgtaatccttgcactttgggaggctgaggtgggtggatcacttgaggtcagaagttcgagatcagcctggccaacatggtgaaaccttgtctctactaaagatacaaaaattaactggatgtggtagcgtgcgcctatagtcccagctactcgagacactgaggcaggagaatcacttgaacccaggaagcagaggttgcagtgagccgagattgcatcactgcactccagcctgggtgacagtgcaaggccctgtctcaaaacacacacacacacacacacacacacacgtcatgaattaagtgttaatgagaaaataacaatgcggaggaagataagtagtattaggggaggctgaaattttaaagcggtagctaggaaaggccccctctggaagacgaatttgtgtaagacctggaggaggtaagggaaaaagtcaaatggttccctgggggaaaagcattccaggctgagggaacagcaagtctaaggcccctgaaggaagacagtgcctgccatgctccctgtgccgctggaaggccaggggctggtattgagtgatccagtggagaacactaagaagtgaagcagcagggaggtcaaatccagcacggcagggcctttggtacagagggaggactgcggtttctcttctaagtgtgatgaggagggtcacagggagggcacaaaccctggagaagcacaacacaggaccaatccccataacagcagctccaccctttctcacttagactgggctagagtggttaagcatgaggaaaagagatgggcctggctttctgtgcctcaaagcaccacgtcaagctgtgacataggcatccaccactcttcctttgtgcctacacctgtatttttgaatgtactctcatcacagtgtatatcaccgtgctgttcttcaaagtcagtttccccagtatttgttcaataaatgtttaccgatcactcattacgtgcaggcactatgttaggtgctaaatagtacagtgacataaaaggctgtaaacaattaaaaaatcaacgcctcttatgtcagaaaagtaacactgtgtcatcaaagcaaagtcgacttctcctataggtgtgggtatatttaggatttgagaagggaaaaagcgtgcttagcttccgggctccaatgtgcggatatacaccctctccttagcttgttagcttagggatttcccacccagttgcacacggtgtgttatctgaagtcatttaacctgttgacagtcgcattcttggaataagtaagttccatgcaggtgaacttggacaaacaatgccagtaacctttttagctgctgaagtaattggtccaaaagtttaaaataataagcttcattttccactgaatcttgttgacagagagtatcagcagggcttggagttagaagagtctaaatccctgatgaatagttcaaaaaaattactgttaaactttttgtaaacaaggtttttttagtcataataatgtttttaagataaattgtgtggataattggtacaaacttacgatgtatgcatttagttagcctcagtacaatcaaatgtgttgttaccagtgcatcaacaaatgcacctcaatatcttaatttatcattcatgataataaatggagacaacaccatagattaaggtaattcacagccttgttctagccaatggcttcaactttctttcctttttttttttgagatggcgtctcgctctgttgcccgggctggagtgcagtggagcgatcttggctcactgcaacctgtgcctcctgggttcaaatgattcttctacctcagcctcctgagtagctaggattacaggtgcgtgccaccatgcccgcctaatttttgtaattttagtagagacggggtttcaccatgttggtcaggctggtctcgaactcctgaccttgtgatctgcctgccttggcctcccaaagtgctgggattataggtgtgagccactgcgcccggcagtggcttcaactttcttggcaaccaagtttattgtaggagtggccaacaaatatcacatccacagacactgatgctaccaaatagaaaggtcaggaaagggccagcagcaacaaagagggaggaggggaatgtgagggtcctaaggaatccacaggctgatggagcatcccttaatccagttaactgaaatgagttagactaagagtctacacttggcccccagctggctcaattcaagtcctcccttggacctactgggactccacctttaggagtggatcctctggaggaatcctggcaccaagcaaacttcccagggctcctttgacttgctggaaattggctgacctctgagggagtgttgtttaaatggatcaatttaagcacagaaagaatccagcctaattttttgtgtgtgcgttttaatttttttttatcagtataggctctctgacatgtcccagtgaatgtgcatgttttttaagtacaatgatatgaaatatattaaaagtatactagaatataaactctgggaaaggagagaacaccgtgtttcctttgttgatattttcccagccctagaattatgcctgccaatgatagatgcttaaaaaatacttgtgagatgaatgaaagaatgaatgtgttcaccaagtttctgacctcaaagagtttaggacctagaagagcagatagggcatggtcagaaatacctatgacaaaggtagtgactgaggcttgtcttaagacagaaaccattaagaggagaggatgaaatagattctgcctgggttgataaggagacatttcataatggaagagtatttggaggaaaaaaggaggaaaaggaaactagaaatgtgggatgggccttctacaaaagatcactgttgaagaaagcttctaaaaatcttctttggtaataattaaaaccccaagacagcacaaatccctgagagacagtatggagagatgtgagaatcaaaacatgaagtaggggcccatgaaatgtttgacaaataagtgccatttcaaaaacgtcatcccatggccaggtgcagtggctttcatctgtaatcccagaactttgggaggctgaagcgggaggcttgcttgagttcaggagttcaagaccagcctaggcaacatagtgagacctgtctccacaaaaaataaaaaaatttccccaggcatggtggcacatgcctgtgatcccagctactgaggaggctgaggtgggaggattgcttgggtccaggagtttgaggctacagtgagttgagatcacaccactgcactccagcttgagcagcagagagagaaccctcacttgggggctaggatgaattttttttcgagacagggtctccctctgttgcccagactggaatgaaatggtgcaatcttggctcactgcaacctcaacctcctgggcccaagcgatcctcccacctcagcctcctgcatagctgagaccacaggcatgtgccaccacatccggctaattctaaaagtgcagtgcaaaacgaagagattgtgaggaactctgtaaatacaaaaggttaaagaaatagtttataagaacagtgaacaacaatgaaactctttatgacagtcttccccataatgtttgctttcacatcaaatcagtcatgaggacatgatataaactatacaaatgagctttcttgacttccttttttaatataagaaattgattgtttcctaggtctcatttcgttgaaattgttggcaaataatactgaagggatgcaatttcacaaactgcaacatgagcaagaccgtatctacagtgttcatcactgtactcgcagcttttagcaccatagctgaccacagtagtggctgttcataaatatttattgaatgaacgaaccaatattttctgagtaggtcctgtgtgcaaagctctggagaggcatgctgggggaggaaaggatggagtcatgatttctcatgaagtctcttcaataacttcacagtccaaggtggggaggggtgggactgtgagtggggaacagacatagacataaatagctttgctgaaattcagggtgtgtaaccacagcagcaagttcaagcagtataaaaataataaactattagatgtcactttacatttatatattattttgtccacttgattatctgaaaatgggaaaaagaagaattattattattatttttttttgagacagagtctcgctctgtcacccaggctggagtgcagtggtgcgatctcggctcactgcaagctctgcctcctgggttcacgccattctcctgcctcagcctcccgagtagctgggactacaggcgcccgccatcacgcccggctaattttttgtatctttagtagagacggggtttcaccgtgttagccaggatggactcgatctcctgaccttgtgatccgcccgcctcggcccccctaaattgctgggattacaggcatgagccactgcgcctggcctaaatttttaattgttatttataaaataaaagctattttatatatattaaaatagtatatattggccaggcacagtggctcatgcctgtaatctcaccactttgggaggccaaagtgggaggatcacttgagcccaggagttcaagaccagcccaggcaacacagcaaaagcccatctctacaaaaaatacaaaaattagccagacctgttggcacacgcctatagtcctagctactcaaaaggctgagatgggagaattgcttgaacccaggaggctgaggttgcagtgagccaagactgtgccactgcactccagcctgtgcaccagagcaagagtctgtctcccaaaatatctatatatgtatatagatatatcaattatataatatatgtatatagacataccaagcaattatatatgtatatacatatatctatatacatatacattcctcattatgtttgctatatacatatacatatatatagatatctatatatgtatgtagctatgtctgcatataatttgtatatgtaatatatgtatatatataattgcttggtctattttatgtatcttgagacctattgaaggtttttgaacatgtgggcaattctggagagtaattactaaaaaaagagaaaatatgggtgaggttttgtttactcaggttttgtttttgttttcccctttacttccctttcattgttattgacgtctataagtatccattggcatgtgacccagatcgagccttattttcctgtttccaaagcatatgattaatttctaacgtactacattacttacttgtttattatgtttattgtttgcttcccctcctctgcccattaacttaagcatcagaagatcaaaaggtttttgtctattttgtccacttttatagcccaagcacttggaaaaatttctgatgtaaagcaggtgttgaataactttgttgactgaataatagtgcaggacatttttgttttgttttgttttgttttgagacagagtctcgctctgtcgcctaggctggactggagtggagagcagtgatgcaatctcggcccactgcacctccacctcctggtttcttttcttttctcttttatttatttattttttttgagacggggtctcgctctatcacccaggctgaagtgcagtggcatgatctctgctcactgcaacctccacctcccaggttcaaatgatttccctgcctcagcttcccgagtagctgggattacaggcatgcaccaccacactcagctaatttttgtgtttttagtagagacggggtttcaccatgttggccaggctggtctcgaactcctgacctcaggtgatccacccaccccggcctcccaaagtgctaggattacaggcatgagacaccgcacgaggcccacctcgtggtttcaagcgattctcccacttcagcctcccaactagctgggattacaggtgtgtgccaccacacccgtctaatttttgtatttttagtagagacagggtttcaccacattgcgcagggtggtcttggactcctgagctcaggcaatccaaatccacctgcctcagcctcccaaagtgctgggattacaggcgtgagccactgtgcccagccagcgtatttattttttaagagcaatattaggttcataaaaaaaagacgaatggaaggtgcagatatttcccatgtatctgctgcccacacatacacatagcctcccccactatcaaaatcctgcaccagagtgatacatttattacaactgatgaacctacatggacatctcctgtcacccatagtttatagtaggttcactcttggtgctgtacattctatgggttttgacaaatgtacaaggcatgtgtccaccactacaatatcatatcgaatggtttcactgccctaaaatattctgtgccaccatattcatcctacccttccctttaacctcagccactgctgatctttttactgcctccctagttttgcctttcctacaatgtcatacacttgaaattgtgtggtatgtagccttttcagactggcttctttcacttagaaatatgcattttaagtttccttcatgttgtttcatggtttgatagctcatttcttttcagtgctgaataatattccattgtctgaatgtactactttatgtatccaatgaattataattttagaacaaaaagtaaggtaagaggaacacaacttttttttgttgttttttgtttgtgttttttttttttttttttgagacggagtctcactctgtcacccaggctggagtgcagtggcgtgatctcagctcactgcaagcgtcggctcttgggttcatgccattttcctgcctcagcctcctgagtagctgggactacaggtgcctgccaccatgcctggctaatttttttgtatttttagtagagatggggtttcaccgtgttagccaggatggtctcgatcttctgaccctgtgatctgccagccttagcttcccaaagtgctgggattacaggcatgagccaccgtacccggccagaggaactcaacttctaatgtaacccgtccccaacccccaggccacggaccattacagtggtctgttagcaaccaggccgcacagtaggagtggatgagtaagtgaagcttcatttgtatttacagctgctccccattgctcacataaccacccgagctctgcctcctgtaagatcagtggcagcattagattctcacaggagcccgaaccctattgtgaactacacatgcgagggatctaggtagcacactccttatgagaatctaatgcctgaagatctgtcactatctctcatcgcccccagtgggaccatctagttgcgggaaacaagctcagggctccgctgattctatgttatgctgagttgtataattatttcattatatgttataatgaaaaaataataaagtgcacaataaatgcaacgcacttgaaccacgccaaaaccatccgcccacaccccatccgtggaaaaattgtcttccacaaaactggtccctggtgccaaaaagtttggggactgctcttctaaagggataaaacagttgccctgagtggactttttgaagatgtaaagcaagggctggggagatgtcctgagcaccgtgggataatggcctttggatggaaactgagttctgtcgttcattcagctgatgtttaagggcgccctccctgggcaggcagggtgctggttcttgagggtgtggacacccagagccagtccctgcgctctcacagttttccctctggctgcaagcgctggggtgtggccctagctggtccgttgggctctgcaggagtctaagctgggctcgggatagccggacagaccccaggccaggggaaagctcactcgtggctgtcgcatctctccctccaagcaggtcgaagaagggggcaaagcagacaccctgagctccaaactgcaggctggggatgaggttgtgcacatcaatgaggtgactctgagcagctccagaaaggaggcagtttccctggtgaaaggatcctacaagaccctcaggctggtagtgcgcaggtaggtggcagacccccaccctgtccctcctaccacctcaccccacctctctccctaccctaccccacctctgggaaaagagctcggggttggtagcttggctttaaacctccatgtatggatcctgcctttttttcttttttctttcctatcttgtgggatgtggggaggaagtggggtgaagacatttcagacactgctgtctttcagaacactcatttcccagcaggtactggtttgtcagggatagacctcactggactacctaaattttgggacctgatgaaaagtgacactcatcccagatgcggtcagagctctaataagctttttgtctggtgggactagagaaagaaattggcttggagctttcagtggcattttgggaaccacacctgcatcacagggttcttcaaaacaggcaaattctctcattggttgttttgttttctggtctcaatagtggtgattcctctgttgggaaagtgttgggttgtgtttgattttaatgccttagcatcagaagctttgtactcccgggaaccaacccttcgtggaggaaattatttatggaaaggggatgggaattgaattatttttttgatctctattagtaagcactgcttgagacattttacacatcttagctcatttaatctgcacatgaaccccatgagatagctaatcactatccccattttacaggcaagagattaaataggttactggaggtagccaagctgataagttgaaaagccagaatagaatccagattgcctgattctatttcatgccacttgagcatcattatcttgacctgctaagcgctaggcccaaatattttgcatatttgaatatttcttccttagatttcagctgcctcacatagcagctaatgttacagtatttaagaatgttctagttggctgagacttcaggagtcatcaatgaagccccaccattttcaggctgtagaaagtaagctggtcttccatcatgccacagatggcctcttaaagacctgcattaattcatttctcaaatgtttcctaagtgagcccatgctcaggggaacagcagctcctcccagccacaaaaaacacagcgatgactgtggtcccactgtgtctccaggctctagtgactctccctagtgtgctgggctgtgtctggtctgtctacagggccatcaaccagcaattgcttctctggtggtcagtgatgcagagtggctcaaagcataggcaccggattcagacagacccgggttcaaattccagggctgtcacctgttagctgtgtgagcttggccaaattacttaacctcactgaaaattcaatatcctcatctttaaatgaggatttaaatatatgtatttatgccaaaatatggcaacaatctaagtatccatggagggacaaaccaaagaaaatgtggtgtatatatgtatatgtttatgtatacacacacacacacacacacacacacacacacacacgaggaatattatccagccataaaaaaagaaggaaatcttgccatttgcagcaatgtagatgaacctggaggacattttgttaagtgaaagaagccagtcacagaaccgtaaaaactgtatcttctcacttatacatggtgtataaaaaagtcaaactcacagaaacagagagtagaatggtgtttgccagggactggggcacaggggaaatggggagatgttggtcaaggggtacaaacttttagttataagatgaataagttctggggacctaaggtaaaacatggtgactacagttagtaatactgtattgtttacttaaaatttgctatgagaatagatcttaagtgtcctcactatacacacacacaggtaactgtgtgttgattaatttgatttttgattgtggtaatcatgacacagtgtgtacatatatcaaatcatcacattgtacactttgaatatatgcaatttttggcaattatacttgggcaatccaacatactttacaaagtgattggaaagattagatgaaacactctgaggtaacaagagatgctgctgctattatttctattattattggccaactctaggcataggctcattccttgcagatccagatttcagtaaagtaagcagtcatctcaaacatggggctgatgtttcaaacagatgggtagacaagctcagaaccatggggccattccttgtgtccagagagtgctgaaggttttgaactcaccttggcattggaacccaggagcccagtttggaaacactgggcattgatctgttgggtactaatggcagaatccacactcctgatgtgtttcaacatgactgtggtgatagattggcctctggaaagggctgctctgtttcctgctatgaagaataatcatggtggcttctggtaggccttctaatagatggtgatataagatttgaattacttcttctagtagaacctttggaaacagacagatatggggttgaaatctggtctggttatttgcaaattgtgtgactttgggctctctaagccccagtttcctcatttgtgaaatggaaataatcattcttaccttgaaagggcattagtgaagtaagtgtaagtacacagtggatatgcaatatttgattattattattctggattaggctagagagatgtgacacatgctaatatggagaagtattgccataataccatatatgctggttccctggttatctggaggccccccctttcattctcttagtgagtttacaaccatttaagggctagtacccagcttacaggtccagaattggtcatgactgtctcagaccttgtggaatttaggagtgttaattcacagtatccaaatcacaagaaactgaaggatataaaccagaatgctactacactgactcattttggaaaagacaactataagtgaaaagtatgccatatggaccaaaaaccagtatatagtactttatccctacaagaaaactaaatgggaagtctaattatggtcaggagtttgcatagtgatttccaactccaagtgaagagaatagttctgtaggcaccagtatttgctaggatccactctgatggccagatggtccatcttcctaataggggcttggctgccaggcggccagagattcacatccagaagcaagggccctttcccctctgggccccagggaatcatgctgccaacgttctcctctccattttcattctcgtcaacaccaaatcctcttcctgattgacacattctttctttacgtatgctaatgcaatcgataaggttactgagcagttcttgcactttctgcttctggtgtgggaaacattttgtccctaagatgccttttgaatatgtcttatctcatctattatgtgttgatttttatagttgaactttcaaaggaaaaggaggctgcctttacatctgacacatgcttatagatggggattatcaacacgcctccagagacatggatggacattcctcccctaccttgcagagatccgggtagaagcctctttgcgctggattaatctggctttgtatttcgtagtgccgtcactttcctgagaagtcttacctttataccttggcacacgtcatcgtcctgagattctgtttcctttgatttattgatgccagagtgactaaggacatttcatttattaactttctttttttctatgtgatctctatactttaaaaaagactggggtgtcttcctggaaacataataggaaggaatgtctgtttcatgaataaatcatttgtgtagtcaaaatgtatattttggcagccatgtacctgcctctttttctcttaaagttattttggctgggcgagggcggcacctcatgtcaggctttcacatccatcataaaaatgccaagaacacagagcagggtaatagtgtttatataagttttgggattgtcttacccagtgaccaaaaacaataaaaagtagaaacaccttcttaaaaggctacagtgacaagaaaaatgcaaagcctcaagtaagttgtgggtcaaagactttcaaagatctgctgacccataaagaaggcagagtttagccctctctgggaggagggcgtgaaggaggcgctgtggacgctgcaacaacagagcatgtgtctgctgcttgatacacgaagagtgaaggttaacagctagtagtggataaatggagaagaaatgataaaataataagtgggtcagagaaaaaacattcccaaaggaaaataaacagctcccagttgcagaaaacccttgtggaatgcaaggacagtgcaaaggatgttaattaggaaagcagacatggacacgaatgagaatcatactccaaatcctccctgaaatcaacagagactttatctggtagatacgtgtaaaatagttgtccagggatcgggtaacctttaaaatggaaactgacaaaggaaagggtcttcaggtttaatttatcatccctgagggtaatggaagttgcgtttagtataaggaatgctcactgctatttgtagataatctaaaacttgaatttaaaaaataggaagctatatttgacctccagaacagattgctggggttaattgctgtgtattcatataaatacatatttttaccctgagttcagactcagactcctatcctgaattggattatcagaatggccttagaatcaatgaatccttaatcccaattctgatcttttctccattttccttggcaaatctaaccttccaaccttctgcattaaggtgctatttattttgtttatttacttattaatccttcattaatcaaaagaaagctggaggtgctatttttgccaaatactatcctactcctaaatttgttgtaagtgaattttttgtgtttttacttgtagttggcaaagaaaaacttgagtatatttcatttcaaatatttcgtacttttttataatgctatgcaagccaggcaaaagtcagagaggatacctgagatagcggtgtccagcactaccagatttgagactgcctgggtttgaagtctgatggcataggcactagctttgtgaccttgggcaagtaatttaatctgtctgatttttgcctcacaaaattgttgtgaggattaaataagaatcatgtgggtatggtatttagtacagttattaaatcatgaatctactgaaaacaagttgcatatttgttaagtaaattatctctttgacaagttccaccttaatctctagaacacagcatatgaagtcctagttaatgggaagactttggtggggaaattatctttctgggcatcaaagagagcagagggtagggaaaattgagccccttttcaaaatggaatcttcctcccaaagctttccatcacctctgcaagtttgatgtaacctttccccttcccatcaatttattctatgagttgatgtgttggaaggaaacaattcttttttatttggctgaatatacgtgtttagtagtactagtagtagtagtatcagtggtagatcacattttgctgggaaaagagagattgaggagaaagcagcattgaaaaagtaaaaaacaataaacatctgcctaaaatatgtatatgccaggctatatgacttgcccatgtagaggtggctagcgtgagaatctaggctagagtgagaatctaggtcttaagactttcagcccttgagtctctgcctggaggtagaaatgagggaaatgcatccaaaaataggtaaggacttgtccaaggccacatactagtggccaaaataagagtctagttcttcgaggatgtaagtcttagggacttttggcccctcaagcagtgaaatcatgaactagtgctttctattccactgcctcctccttttagaaatatctgtgatgctaaaaaaaaaaaaaaaaaaaaagagagagagacaaaagacaaggccgggcatggtggctcacgtctgtaatcccagcactttggaaggcaaaggcaggcaggtcacctgaggtcaggagttcgagaccagcctggctaacatggtgaaaccccgtttctattaaaaatacaaaaaattgtccaggagaggtggcgtgcccctgtaatcccagctactcgggaggctgaagcagaagaatcgcttgaacctgggaggcggaggttacggtgagccaagatcccgccattgcactccagcttgggcaacaagagcgaaactctgtctcaaaaaacaaaacaaaaaaaaccctcaaaacaataaaaaaacaaagaagcttatgtttgattcatctaagaaaacattttgaatgaagaggtgattccccattgaccttgaacttcctttgggaaggaaatgcaccggactactttggatgcccagcagacttgagtctctgcagcagcctctggaaatgaaactctgggctgcattagtggctgcttcctccctcctaacaaaaatggtgatgaaattaagttcaccaagacccttgggcccacactcccccgaattcaccgtcccatgtttctgagggttaacagaatagtttctttttataaactagtgagatgacattattagaatggaatgggatggttggctgacacacttgctacctcagtgtcagatttctgtgaccttatatttctagattgaattgcaagactgtaactcacccaggatttgcaagtcaatgatcttaaaagaaatactttgtaatgaacttttttaagtcctctgaaaggatacaaaattaactctattagctattaataaaaagggttgtgcaaatcagtgccttttccagctcatggttacagtttataaaagaaaataatttcttggaatattttcactaccacctcctcacttccttcacactgttttgccacctctccaccccctcacctgcctgactctatttcctgaaaaagcatctacattcttaaagcagtttgagattaaccacctgatgtctctttctgactcttttaaagcagtttaaagaagcaatttattaaaagctttaaaagcaaatggaacagaactccctatttttaaggcaataaagttgacaggaagggttgaaacttttctagaacataaaaagcatatttttttcttataaattgacaatctgcaagccagattgtgtagcacgaaggtgccaattctcagatatgaaattgcaaacagcatgaggaagacattatatcatctggattccagtctcagttctgctgtggtctggccatcataccacggtgctactcaatctctctaagactaaatttcttcttaaaatggaggagaacagttccatactgagttgctataaggatgaaataagatagtatatataaaatgtttcatcatagtaaaatattaatctttatttcataaggagcttctattgtacagtctcatgaaaagttacctgaccacattctctgatgattgctctatttaatggcactgatttgactcatttttgtaaatgagaacacataggttttaaagcttctgattataacctttctgctaagaggaaatgtggctttaaaggacagtaccaactaggcccaagttcagaatgggattttgtaaaaaaggccatattctctggcgaacgtaagttgaaagagttctaactttgaaccatgttgaagctcattggtggaaggttgagctccaggagaggaagctcggattgcaggaaggggctctctacgcaagtgtatttgcaccatctggtgtttttttgttccaaggactggtcaggttatataggcacatgtgacccaggctgagcaatttgaaaacataatgttctttagacagcacaatatgctgcctctgggaaagttatgacatcaaaagataactatcaagtgggcaggcagtgggaggtgaggacaaacagaaaaggtgcagtgacctttttataggcaattgcaaaactggtcttgaagctcaaggaactcacctctgtgcataaaagtgtggcttcctctacctctcctggacacagaagacaaatgagaaatatttctgtgccatggtaagttccaagaactgactttcaagacacaaaaaaaggcccgatgctgtgctctgtggttaactcctgtatgaaggggcaggaaggcagtgtgtccccaccacgtgccacaggaggaaagcacaggagctgaagtggcagccagcatggcaggcagtaccactctatggttctgtgttaggagcgtctcgtgtctgaaatgttacctctcacctccacatgtctcctgaagagctgtgaccaccctcccatgccccgctctgctctcccttcattacttcactcatcctggtcatctgctctttgaagttcttaatttgggcaaagggctggcagatgcctgggacatgagtacaaatcccaaactgcacttccgtttgcacccaggatgagacttccctagaggggagatcagtataactgagaactgtggtaacttacccttctaaacattttttccacttgagcaagtggttgagaggagaggaaggaggcagctgcagtggcctctgacccccagaaacttttccaagaggcctggcatcatggaaatttgctcagtatgctttgaggaggtatttcaatcctgctgggaccattctcagagcagttttcggcttctttggacttctaggcttgaatgtcactgtatagaagtatagtattttatttcctaaccagttgttccttcccatggaaaattcatgtaacacattattaggtttcctgagaggtatgcaataagactcccttactgtaatgaggaaggggacatctttttcccccgtagcacataatgataactgctatttttattcaatgggttacatatgcttactggctatgcactaaacactagcttcatacaaaggaatgttctattgttcctagtgaaggaggtttgatgataaaagaccacatttcattcttgggctagcacagctttacttcagacaaatgtattccagacaggagccaaccttctataccattaaagaattaatgaatgcaccattaaagaatggcactcaaggctgggtgcggtggctcatgcctgtaatcccagcactttgggaggctgaggctggcagattatgaggtcaggagttcgagaccagcctggccaacatagtgaaaccccatctctactaaagatacaaaaaattagccgggtgtggtggtgggtgcctgtaatcccagctattagggaggctgaggcaggagaatcgcttgaacccaggaggcggaggttgcagtgagctgagattgcaccattgcactccagcctgggtgacagggcgagactccatttcaaaaaaaaaaaaaaaaaaaaaagaatggcactcaaatatctgtctgagcctttaggatatgaggtctgagttctgagatcaaataaaagttatggtggaatctttccccccagttttaaatttggatgcatcagctaggacaggtaagtttggatgagtcccatttagaagatgaaccaaatatttggaactctgaatacttgaatcaaaatggcttaaagctactccttcttaaattgggctacacattggaattaccaagggagttttaaaacagcaataacaacaacaaactaattcctggctcctacctccagaaattctaatttattttattttacttgttttttgagacaagatcttactctgttgcccaggctggagtgcagtggcatgaacacagccttgaccttctgggatcaagtgatcctcctacttcagcctccggagtagctgggactacaggtgcacaccaccacacccagataatttttttattttttgtagacagagtctcgctttgttgcccagactggtctcaaatgattcccaccttggacctcccagagtattgggattacaggcgtgaacctccaagtccagcctcagagagtctaatttaatagatgtgggggtgtagccctgtattggaaactttaaaagcgcctcaagaaaaaggctgggtgcagtaatccctataatcccagcactttggaaggccgaggcaggaggatcccttgagtccaggtctgcctccagaccagcctgggcaacattgcaagaccctgtctctacaaaaactagccgggcatggtggtgcgtgcctgtagtcccagctactcaagaggctgaggcagaaggactgcttgagccaggagattgaagctgcagtgagccatgatcgggccactgcactctagcctgggcgacagagcaaaaccctgtctcaaaaaaaaaaaaaaaaaaaaaatcaagaaaaaacaatggatggttcatctgtactgaaaatgtacagcctttttttcttgtcattcttccctaaacaatacaacagtgattcacgtagcatttacattatattaggtaggataagtaatccagagatgatttaaagtatacaggaggaagtgtataggttatatgcaaatatgacatcattttatacaagggacttaagaatccatggattttgatacctatgagggggtcctggaaccaatcccccatgaatgcagagctacaactgtattcatttatttcatcagcccccatgtttcaaaaaccacactttgtatacccttagcataaatcccccatttcttgagaatgaggggtagagaaatggtttccataaaggattgttaaataccaccccctccacatatccttaatggaaaatcagatcttcgaaggtcctggcaagctttgtcctgttctgtttttctgttttatttaatttaactgctctaagatcacaagtgtcccatgaaggtcctggagaagaatcttaaagtataggtttgtgggttactgagagcagtagtaggctcttagacttcattaggcaaagagaaacacctggttccatctgacttgagatgaactgtgggttctttttcctttgatcattgtttattaagatggctacctcaaatatgtattttttaccacctgtctcctcatggttctgttgctttgggcatcttcgcatgtggcagctctgaagagcctcattagtcgttggcaaaattatgtctctaagactagcgtctttgtgcttttgccagtagctaaaatgtctgtttaattgtattacctagtctagaggcccgtgccgctgtctgtagaccagctgccagattgcttagtacagtttgtcagtgcatttgaaaaacgcaatttttctactcccctcttattctgctgtcaaactctagtctgatgctgcgtttgcttagtgggtgggatgtgtaaaattatacatgtggggacagttgcttggttagtgtgtttattgtttacgtaggaaggttgctatgttgttttcatgaagactgtgattctaaggagcatttttaaaagattctttgggtgccaggcgcggttgctcatgcttgtaattccagcactttgggagaccgaggtgggtggatcatttgaggtcaggagttcgagaccagcctggccaacatggtgaaaccccgtctcagccgggtgcggtggctcatgcctgtaatcccagcacttcgggagtccaaggcgggtgaatcatgaggtcaggagatcaagaccatcctggctaacacgataaaaccctgtctctattaaaaatacaaaaaattagccgggcgtcgtggtgagcgcctgtagtcccagctacttaggaggctgaggcaggagaatggcgtgaacccggaaggcagaggttgcagtgagctgagatcgtgccactgcactccagcctgggcaacagagcgagactccatctcaaaaaaattaataaataactaaaaagattctttggaatgtttctttaaaggtgtctcttagggatgagccactattattttttgattgtaaataagtaggggcccacaagccctggacacctaaaacaatctttcatggaattttctcaggacacattttgtatgtccttcaccctcataacttaaagaagcgaacaattgaagagacccattgttttttactggtggttacatggtactgaacgttttttttttttaactaaattaaaaatctcctcaattatcccctctgacttgctccctcacttccttcaggtatttgctcaaatgtcagcatcccctgcagagtccattttacatcgcagtcccctttctcctgtatcctcacacccttctaatctttattttttacctgtctctctgtcacacatactagaatataagttcttcgatggcagggattttgttcggtgtggtatccgcagtgcttggaatggttcctggcacacaaatgtgctcactgaatattggtgagccagctccaagccaggctgcctgacattgcctctcagctttacaacatttactactgagggcccttggacaagttaattgccctgtgccatggtttcatgacttgtaaagtggggatagtaacagtttccccttcacgggtataataaattgctgtctaaatcttggctgtttttaattacatcatcaaatagcgttagttatttttcctgcattaagagctgctggacaggcagtctgcacttatcttcactatccttctattccctatggaatatggtcaatagtttcatcacttaactgaccacacttttctcctgtatcccccaccaaagaaggatcatattcgaagtttgttttcccctctgtgaaatgagatcgacctaatttcctcctgccttaatgcccctgtgtatcttcttagtaaggtagcctgtccccagcccttgttcgggagtgaggtccccaggagcctggcttcaggggtgcttcttgtagcaggacccacccttctctctgtcctcagcttcctcaagtctcactggaataggtactctttgcagtcaccttgttatttggaggtttggatttgtttctactactcccacctcctacccctcagggagcagtgctgtgcagcggttaggagcactggctttaaatctgatagaatttggtttacaaccctgcccgttctgtgagatcttggccagtgacttcacctctcacttttttatctgggaagtaaagacaaccatccacacttcatatggaggttgtagccataaagacaacctgtgtatagaaaaaaaactcagccttgggtttggcacactgttatcaatcatctcattcataagttcaaccatagttattgagcaggtgctggcaccagttctcagcatatatgtgctgaatggaggcatttctatttttcactaagtagttttccatactgttagctgttttatgagtaaaagaacagatccaaccgaggagggtttggggcttacgtttctcaccagtgaaagttaaactaaaattagaccgaaatccaatttgtcagggggggaaataaagcaatgggaaaaggtgacttgctaataacgatggatataaaactttagtacggggtggatgggtgagaggtcactggcaaggctcctctcctgacctccagaggggtcattttggagaaactgctgcctgctttatgaaggtcaaagcacccagaaatgaaaggacttagcctcaggtcacaggtctagtaaaccacagaatgaggaagagaagtcaggttttctagcaccagccaagcctgctctctcagggcatacataaaaatagaaaactccaaaagccagagctcctttttgccttaatcttatattttctttcttactggtggtaggaaatggataatttgggatgttcatgttttgttagatgattctcccttctctctctcacacatctttccagttttcctagttttccagttttcttcctatgacagttttttttttttcccctcaaagtgtggtctttagacaacttgcatcaaaacggctgtggtgtctatttaactcgcaaatcctttgtacctcttcctacataagactgtcttgagggaagcctgccttttaacagatgccaacacccactgaaacttgcagcctctagccctaagggagtggacatgctcttctctggctgggtgaggtcaaccccatgaatctttcctgcctcattggcccatgtaagagacaaaaggatgagatcagtgtccatttgagcaactccgtggttattcttcaaagtctctagcatcgtgcctttccttggccttgatatataggtaaagttcaaaattcaaattttctacttcaaataaagtttggggatggtttttatttctgtgaactccttcagaaacattttagaacacaacccaaatgctcagaaatgttaaaacacacacacacacacacacacacacacgcacaccagtacttctcagcctgccacctttccaagggcagagcaacctgcagcagtttctaaaaatagacctttctgctacaggtcactaagcaggaatggcctccatgtcactctgtttacagtttcacatctgacaccttcataacaactgtgctgacttgatgaggcatgaggaccaacatcagtctgtgggaactcctgagaaaatgcaacctggggctgtggctggtgtgcaatcggtggcatccccacaaaatccagccgtgtttggattcaaggccctttcaacctttgtttgccattcctcgtcacctttccatcactgtctcaaagtcaggggcagaggtcaaaaactccgagtcactccatgaggtagcaatgaatataaacatgagctcatgttcaggaatttaagactcaccgtgttttctttcgttttgtttaatctgtcttgcatttctcctctttgcaaacttgtgggtttacaatgcatcatctagctgcaaatttaattttaggctctttcaagaaaatgctcagaaaaggcgaacttatctttgctatattcaggacagccctgcaacagtgagggctgtgtaataattcatgcacattcccgtcccagtccctaagtgtgcagactacgtgggtggtattagaattaaaatttcttgggattaacattctaaaattaagaaatggggtcaaagaatgggggcacttgacactaaatgtacatgaggtgattggactggattactgagcattcacagtcataggattcctagtaagttctgaagaagtggaccaattgttatcagtttaggatcctacttacaggaatcatttttgatttgcaaacttagcctgctatctttaaataaataattttagtaagctctcaaaatgttagctttgggtgggtgtctaagcattttcattctttgatttatttctcacaacaccagtaatagggattattactactctattttacagacgaggagatagacttgcaagagggcagtcttatcaaggggatacatgtgttaagtgtgaatttaaactccagtctatctgatacaaaagcccaagcttttacatcagtaaaaactagttcagttgagctggttttcagtgattgctgaaatccctgaaccaatatgggttcttcagcctctgggagaagaggagttgggcttggccaatgcttttatttgctttgctttaaagaaagcacacactgggcccttttgttttcccagcagtgttgattcacgttcactaaataaattagccttcccgtgttgtctcactcatttgacattagcaagtttacatgccaataaaaatagaaatgggagaaacaatactgcaagaagagagaagtggcagaggcgttagagtgcaccaagacatgaacacaagctcatcattttctacactcctttcaaaacaaaacaaagcaaaaccccacagcttgattccaatcacagtttgttctgtgattttatgtggttgaaatgcctgattaatactgaaatgttgtaacattcattattttgtaagagaatagttgagacttccaataagattttatcatttctcttccaaatagtggaagcctgataaatgatgttaggattctgtactagtcttactagtacttattcatagatctagaagtctctgtgtccattgtgagatgggctgtacgtgggtcaaatacagcttctgaagaagttgagatttgtctttgtgctctgctattaacagcatcctaatgaagcactcaagctactcccatcttctctctgcttcctccatactgcgccccccagcccaatctccctaaaatctttccttcctgagaattgttcctccatatctgcctctttcctggatcctcatccaaacttgcctttgcatttcttactccctcagagccttgctaggagatgatttgctaatctttgacatggctaagaatagtaaatgtcctttgagaacaatacaatcttgcactaacatacaacgggaataataaagttactattcatattttaaagggcaattttgcaggttgtcaacatcttaccctaaaggagtgagttcccaatggtgtaatctcagtgacaaactgtataccgtgataggtgacaggaccttcaggtcatgggcagaaagtgatcttaataaaggctgaccttggccactgcagcctgcatgttctggggcatcctgaggtctccctgtgtgactgacacttcccctgaggactattcccagtgcagtcagtaggaaaccttagtggtcaatgatggtgggccagggaggtgagggacagaggatgtgtcagatatcctaatagtatatacagtttaaagactcatttcataattttgggagttgttttctagggatattgtgatcgttcaaatgtaaatatctgcatcttgaatatactggaaaaaagtgattggcatgttttaggggcagctctagcagtataacagtgtacgggtttgcccctttatggtttgtgggtaggaagagatttattctgaactagttttctctgctacccaactgcttatgaaatatgaacacaggctgggttcagtggctcaagcctgtaatcccagcgctttgggaggccaaagcaggtggatcacttgaggtcaggagttcgagaccagcctggtcaacacggttaaaccctgtctctactaaaaatacaaaagattagccaggtgtggtagcacacgcctgtagtcccagctgcttgggaggctgaggcaggagaattgcttgaacccaagaggagaggttgcagtgagctgagattgcaccactgcactccagcctgggtgacagagctagacactgtctcaaaaaaaaaataaaaaagaaaaaagaaagaaagaaatatgaacacaagcttgaaactcaataaaattgagatttagatctgtcacttgccctcaacaggcacaacaaggtaaggtggccagatttaacaattaaaaatacagatgtcctattaaatttgaatttctgataatcattgaatttattttagtcaaagtaggtacccaattttatctaccaaacctagtcacatgacaatttagatgtatagaaaaaaatgtaggttccttgtcttccttacaaacccacttctgctggttggcaataataataataataataataataataataataataataataataatttttattcctggccaagttaaaagctcacctggtccaatcaatttgaatagtcccttaaggggctcagtctgaaataaaatcctcccttgctcagatgtcatcttttttctccactgcccagctgtcttgctaaacagtgtctggggatttggagaagtggtgagcgcaggtctttggcaccatctcccctggtcccttggctctgtccatagccttcccagccactgctggcctccaacgctgaatcctgcagctggtaaatccatggtcagccatggcctgggcaatgcccctgggattgctggcaaccccacacttacagattcagtctctgctcagctccccttagcttcagacaacttagcatctgccaaactctcatcccagcaactcctgacccagggcccatcctaggatcatctcaccccaccatagttgcctccttgcaagtctgctggttgccgtctgatgtctgagattcttccttctgtctggacctctagagacctcgaaattgagccaggccagacctactccagtgaccttctcctagggtctcaaatggtgcagtggagccagggttccctgagccctttgacattctcctcacttagctcacacactttccctctcctccctgaggctagaagagaaatcagaacttggtcctcacagcttgacttgccaccatcttttccctcatttccacaagttgctgggatcttgagggctgggttttctcactatttctcactcttctctgtgcttccctacttctataacttcaagcttcttgtcttagttgggaggggtatcttctttgcacgatgggaaaattttggcaattagaatcctctaggcctcaccctggataggttacaatggttgtcaaaagtgtgatcatgcccaggaacttctggaaaatacaaattcccaggccctgctctaagcctaatgaattgggaactctggagtttgagcctagcaatctgatttaccaagtcttccccatgattctgatgcaccctaaagaaccatggcattaaatatttcagcaaattctctctctccctctctaccaacgcctttcttaccatttttcatgcctaaactcttattagacagaccggatactccctcttaatctaattgattgattagctacataaactcaaatcattttgtgattaaaaaaagaaatgtatagccttaaaagcaaaggaaattctgatatatgctacaacatggatgaaccctaaggacattatgctaagtgaaataagccagtcacaaaaagacaaatactgtaaatgattccacttgtataaggtacccagggtagtcaaattcatacacaaaaaatgtagaatggcagttgccacaggttgggggaggggagattagggagttttgttgagtaggtacagagtttcagttctgcgagatgaaaagagttctggacattggatctacaaaaatgggaatatacttaatgccactgaagtgcacccttaaaaaacgggtataccagcaaaccaaattcaatagtacaccaacaagatcattcatcacaaccaagcgggatttatctctgggatgcaaggatggctcaacatatataaatcaatcaatactatatatcttctcaatagaatgaagaacaaaaccagatgatcatttcaagtgaagctgaaaaagcatttgatcctttcatgataaacatcccttcatgataaaagtccttcaaaaaactgggtataggagaaacatacttcaacataataaaagccatagatgacagacccacaactagtatcacactgaatgggaaaaaaattgaaagcctttcctctaagatctgaagcacaacaaggctacccactttcactactggtattcaacatagtactggaagtcctagctagagcaattagacaagagaaagaaaaggcatccaaactgaaaaggaagaaagcaaattatttttatttgcagataagatgatcttatatttggaaaaacctaaagactccaccaaaaaaactagcagaattgataaacaaattcagtcaagtcacaggatacaaaatcaacataccaaaatcagcagcatttctattaggttggtgcaaaagtgattgcagtgtttgccaataaaagtaatgacaaaaactgcagttacttttgcaccagcccaatatatgccaacagtgaacaatctgaacaagaaatttaaaaagtaatcccatttacaatagccacaaataaaattaaatacccaggaattaaccaaataagtgaaagatctctataataaaaactattaatataatacactgatgaaaggagttgaagaagatacaaaaaatggaaagatattccatgttcacaaattgcaagaatcaatattgttaaacttctcaaaagaagacatataaatggcaaacagatatatgaaaatgtgctcaacatcattgattattagagaaacgcaaatctaaactacaatgagatattatatcatcccacccccgttaaaatggcttatatccaaaagacaggcagtaacaaatcctagtgaggatgtggagaaaagggaaccctcgtacagtgttggtaggaatgcaaattagtacaaccactacggagaacagttcaaggtttctcaaaaacctaaaaagaaagctaccatacgatccagcaatcccactatggggtatataccccaaagaaaggaaatcagtacctctaagaggtatctggactcctgtgtttgttgcaacattctttacaatagctaagatttggaagcaacttaagtgtccatcaacagatgaatggataaagaaaatgtggtacttacacacaatggaatattattcagccatttaaaaaaatgagatcctgccatttgcaacaacatagatcaaactggagatcactatgttaagtgaattgagccaggcacagaaagacaaactttgcatattctcacttgtttgtgggatctaaaaatcaaaacaatggaactcatggacacagagagtagaaggatggttacagaggctgggaagggtagtaggaggctggtggggaggtagggatggttaatgcatacaaaaaggtaggatgactaatacctactctttgatagcacaacaaggtgactataatccataataatgtaattgtacatttaaaaataactaaaatcgtgtagttgggtagtttgtaacacaaaagataatggcttgaggagatggataccccattcttcatgatgtgattattatgtgttgcatgcctgtatcaaaacatctcacgtaccccataaatgtatacacctactttataaccacaaaaattaaaaattaaaatgttaaaataaaaaatgggtaagatggtaaattttgttataaatatttttaatttttaaattaaatttttaaaaataaaaataaaggactttggtgattaaagcaaaaataaaaactgggttaaaaacagtttaagcaataggtattgatttggtgaatggtgacatggccaactcagctgattattcattgaacgtaatcctggaggttagggttcagaactgaatactggaacaaatgctcctggtaaacatgagtatttcaccaaaccttaattgaatttctgatctacctaaagtataagaaggagctggtcaaatagatctgactctagcgttccaaaagggtaatcggtgtcagtgtgtctgttgagataaaagataatctatacttgaaattttcgcatatcacaggctaaaaagccctctgtgtaaattaattcctagtggtctatatctttctacattaaaaatatgggcaaatcaaatttccccatccaccaaagggacgaggtgctggggaaggtctgattgtttactctttactgtgtattgttgtcagcagtacattggttaactaggaattattctaagtcccttcattgccctgttcttccaatcatttggcatcaggtgaatggttccagcctccctagaggcagcaataaaggacagggactggtattggaagatggtggggctgtagaccaatacctctgcctcctgtattatttgtctacccaataaaataatattctttaatataacaattcacgtttatcaatcttgttaaaggatgaattaaagaatctttagaaaaatgctccagtctaggtaaaatctgaacttattatgcgtaacacaggttcaagacaagtcccctataactccttcacaatccagttgctaacatttagcccctcttataagaaattctgcagccaccactgttctaactccatttccatgctgcatacattttctgagagggagaagaatctttaaacatcaaattctgccatctgtctcaaaactatattcatataagacaatgtttccataagccccaggaaattggtttaggtaaataaaggtagataatatctatgttaataaaagatagtgatatattttctctctcttcttcttactgtgttcattgtttttttttaagtacctaggtaatgtcatcttttaataacccacacctccaccaatccttataatgtaaatcattcagaatttagattctaaattaaataaggtttattatgctcctggttaagaaaagaaggttatcatagttttgtggaagagctaagaaaacacacccctaattttatggggaggctatggagtgcaatggaaaagtacttgaactttggagtagccctgactttgaatctggacttttcacttattggctgtgtgaatctagctgcataacctattacaaactcagtttcctttagctatacggttggaggaaactttatctaaatttgtatctcagggggtttttgtggtacttaaatgagatcctctatgcagaagcagggtgacaagcaagtacttggcatatggtaaccgcacaggagatggtagttatcagaaagaagaggtgtgtgaaagcagtaatcaccagagctcttggctaactttgtgaactgcatggggttgttgagtttaccatcattctttttggttgtaccttacttatttgaacacagttttatttctttcagacttgatgcaactatatctgttatcagtttctcatggctaagatgtgaacgagacaacaataggcaaagctcatttatgatgtagacccaaggtgggctggaaagtctggaataagctggaaaggtcttgatggaaccttttgtgggtgttagaaatgttctatatcatttttaccctttacatagattagtacactttatccattctgtgtatgttacactttaataaacatttttaaatgatttgataaggatcacaagacccacccataccaaatccactattaaagcaagttgattttatttttaataagcctcactgaatttaataaagttttttgtgcgaatttaaaaatgacatctggctgggcatggcggctcatgcctgtaatcccagcaatctgggagtttgagaccagccctggcaacataatgagaccctgactttacaaaaaattttaaaaaatttaaaaaaaaaattagctgggtgtggtggtgcttgcctatggtcccagctactcaggaagttgaggtgggaggatcgcttgagcccgggaggtcaaggatgcatgagtcgaggttgtgccactgctctccagcctgggcgacagagtgtctcaaaaaataaataaacaggctgggcgtggtggctcacgcctgtaatcccagcactttgggaggccaaggcgggcagatcacgaggtcaagaaatcgagaccatcctggctaacacggtgaaaccctgtctctactaaaaatgcaaaacattagctgggcgtggtggcaggcgcctgtagtcccagctactcgggaggctgaggcaggagaatggtgtgaacccgggagactgagcttgcagtgagccgagatcgtgccactgcactccagcctgggcaacagagtgagactctgtctcaaaaataataataaacaaacaaacaaacaaacttacacaagtacttggtctacagatgtttgtttaatccacattaaaaatctggaagttttgcataatctggatttctggcttgtggagaagtcagacgatctggcagcagtgggctggagctgcatgcttccacgtctaatgaagcattccctctccagtttgccttggggccccactgtttcctgtgatcctacacctgttgctttgctcatttactccacctgcctggtctagtcagcatttgagtttgccagccttgtaacacaaacactggttggccagttatcttcttcatctccagccaactgacaaagttatcttttccactgaagaactggttgatgatttttaatcctaaatcggggaagagaatcgttgtgtcttactctttgatctctccagtccacggcaagcattcatgaaatgcttgttgagtgaatgaaaaaccccgcatcatgtgctgactgcttgtttgtacgtatctcctgtcacatttcttttcatggcacatgggtttgttagtcccactgtgattcaaaccgtccttttctaccatagcacaagatgccgggttaggaaagcgaaaggaaaaatgttctcttcactgtcagtttaaatcatgatttgaagcaggttttattataccaaattatcatcaggctaattgcttgacaacctctcttgttactgctggctggcgccattcaactgatcccctctgctgatatctggctgggagaggcgtggcatatcctcactaaggagaattctgctacctggaaaaatacccaaagctgctaagcatcatacatgccatctatgtcccattccgaagttgccgtaaatccaatatgtgcagtagtgtttaagagcatatgacttgaaatcaggttacctggcttcaaatcctattactaccacttgttttgtgaccttgggcaagttctttttttttttttttttttttttgagatggagtttcgctcttgttgtccaggctggagtgtaacggcgtgatcttggctcactgcagcttctgcctcagcctcccgagtagctgggaatacaggcatgcgccaccacacctggctaattttgtatttttagtagagacggggtttctccatgttggtcaggctggtctcgaacacctgacctcaggtgatctgccggcctcggcctcccaaagtgctgggattacaggcgtgagccactgtaccccgccaactttgggcaagtttttaatctctctgtgcttgagattctccagctgggaaatggtgataataacagtacctccctagtggagtggttgagagagttaaaacaaaatatgtatttaatatcctgcctgatgcctagtaaacactctactaagtacatatgtaagtatataaacgtaactgatatgtgcttctacctttccaccttattctttttttttattatactttaagttttagggtacatgtgcacaacgtgccttatttattctttatattagctgtggaattgtcccagagattgaaatggatcattaataatgctagtttgtgttccacaatgatttttctccaagaggctttttttttcattcctaagaataaattgtgaacccaaatgtaactcttttacctgctattcttagcactaaatggtaacttggttttccctgtctgggatgttgggactttgaagggatgattgagttcaatgcctttaattgctaccttctggccagtaacattcttgtgaagaaataccttggtttccccaaagaattaaagaatgtggaaagagagaaaaaagaacagggggatatgattactttaggccagtagaaaagaagcaaaattaaattgaaaaaatgtgttgattctcatctgtaattccagtcattttcatttgtgtgcctttcgattgctgtatcataagtggtttatgtcctacagttattatactggacaggcattgtataataatactttggacttaactgacatcttttatgatactaagaagcctggagccattatctcatcaaaattgttaaagttacggtgtcatcagcctgggataaaaaatgattgcctgagtgtaaaatgagcattgggctcagctgctgtgtgtctgcttcccttacagcattttcaaggatctgactctttcagacatacttggagttcaacaaatacaatttcccaggaaattaaatgaaaatgggctataagggagaaactaagcttactgagtttctatctaggctcactgcccagttttctttcaacctgaaacctatatgtgggaatttgcagagttgggctaaactaatcgtgaaccccacgaagttcatttactgtctaacacatcatcatcatcttggacctggtctctaccctcaccattgagatttattctacaatcactcttccttctaaagatgcagtgtgacttccaaaagtgagatgtacaggacacctgttctacctgaatcttttgcatattttgtaaagtttatttattaagcacctaataaatgccagccattgctctaggtgtttggaactcagccatgataaaaatcaaaaacctctgtctcatggagctgacattcttgtgagcagaagcaataaataacaaacacaatacatatgtgaatgaaacagtgtgttagaagttggtgagtgctcttagaaaaccagaccaagagttcaagaggctgtttctagctcccccattcataaatttcctaagttcctcctgggagtttaaatggctatgccctacaggcatttaaacctaccttacacagaaaatcaatctaccttacaacacctagagaatagtttaactgttatggacagacccagaaattaaaaaaaaaaaatgagcaaagaaaccacagtcttcattattttgtgcagctttcccaccatagaccttcatctctaatcccaaacaagcacctcacaaggccatgtgcaaatcattaaggaaaaagaccagcggaaatctggtgttcagaaatcaaggctattcatcttggtctgcagttcatcaacagagtaacataaaactctcctgccctgggcttataaaatggcaattaggagaaaacaggatgtgcttgagtagatgagctactagctttgagagaaaaaaatgaaagcaccatattcaaacactcatctagtttattcctttttatcctctcttcaccacaaatattaggactaggaagacactgagtgatgttctagaccagaggcctcctccaaggatgaggaacagagccttagacaataagtaacgtgttcaaggtcacgtgctaatcagtggcagagccagaagggaaagcaatgtcccctcccttctggtccagtgtgcagcggggtccacagcactgcttccagattagatcatcattacttcttccaacaagaatggcctaaccctctgcaagtgattgccaaagaatctggacaggtagaaagtgagaagtcaagatgtttgtgagagcattccacatgaggaacagatgcgtttgtttttgatcacagctgagtctgaatgctctctagaactcagatgtagagaaaggaggaaatacaagatggggctgtgggcaggtcttacctgggctgggggagcagcgtggtgtggatggtcttccttctaaatgaggggagctggtgcacattccagtgtaaagaacatcctatgcaccagagttgtctgcactgacttaggacggcatcatctccagacttgaggacccctgagctcaccattcttctgtccatgagtggccacccaaccacccaagggtgaaaggtcgtgctctatgctctcacctcaggtcatgatgaaggtaggaagagcgaccatccagcccataccaccacaactgggtaacattagagctcttcctgtagaccaagcactatgctaagtgctttttcatagcatcaccttcagtcctcacatcagataggtacccatttcagaggagagaaaactgacgcttggaaaagctgaataatttgcctgcaatcacaaagctggtgaatgcaaagcctttatctcagagggtggtggttcagaacatgggctctgtggtcagattgcttaggtgtgcattccagatctgctgcttgctggctgtaaaatgttcaacaagttacttctcgaagcctcagtttccacatctgtaaagttggagtaataattataatatttaccttatagaattgtggtgatgattagagaatgtaacatggtaactaccgacacatagtaactactaactatgggtcaactgtaggttggaaccacatgaaatttctattgtagtggaccaaaaattatcaaatattggcaatttcatatggttcaatctagtattactaaaaggcatccattctttgtaaatatcaatgctttccttattcatctcataatttgtgaaaggacaggttatttaattgcttttaacttttccttgttttagtttccctaaagagtgacatagaggctgggtacggcggctcacgcctataatcccagcactttgggaggctgaggcgggcagatcacctgaggtcaggagttcaaaaccagtctggccaacacggtgaaaccccatctctactaaaaaaaaataaaaaattagccaggcgtggtggcacatgcctgtaatcccagctacttgggaggctgaggcaggagaatctcttgtatccgggaggcagaggttgcagtgagctgagattgcaccactgcactccagcctggcgacagagcaagactgcatctcaaagaaaaaaaaaaaaaagagtcacatagatttcttttactgtaacaacataacatccatgaggactgtgtatgcaatatacacagttccctgagccaacacaacctgttgaggatgttgtcacagagaatctggagcagagtggatctgaagtgagcttaaattggacagagctggactatgaggaagtgactggtgacacaaatgagtccactcctggctcctttaaactactgtgaatgttctggtcttttcaggaatggcgttcccatactagccggctgattgtgataaacaaacgtcaaacatgaccattcgtcattccgcatagtggagatgagctctggtctgcagcaggaggttgttaaatttgacatattcaaaatgaattgcacggcctggctgctcttgaactctggcttgctgggagtagcctatgatggaaggaaattccactctgtggtggtgttttggggaggttgcatggtggggagaggaaaacataaagctgggataagaacagtgctttcctaagaaaaaaggaggctacttttgaacgaatgcatctatgatgccagatctagtgggaggcttctcttcttttgaaagatgattctgtgccccaccccattcctatcccacatttgcctcaatttcatttccttagatttcacattatagagatataaataactctggaattcaagtggaacattctagagagacagacattctagttaaaacaggaacaatctttcaataaaattagtatcacctttgaaatgcaatgatactttgaggatgcttcagactttgttggtgtttggaatgattactactgctggtagaaaataatgccactgtgaattcagaattctgtgtgtgtggggaggggggcatgctccctttctctcttctttctgtgcctaaaaataacctgcaaatcttgttcaaattcttttgcaaggaaatttataaattgtctgtgtattctataattattttcccatcatgatggctctaaggaaaatacatttacatacccataaactcagacactcttggagtcccattttctttctgtgtgtgctgttccttttctctttctctctctctttgtgtctatggttactgttaagctgacccctacagtctggggcaaataccaaacttgaatcaagcactacttatccatacagctgcgaaggattgcggtttcagggcctcagatgatagatttaagtaaagtctgtaactggatggagtttaggaaacctgttatgatttcatctacaaaggcgggctgcatcgcaccccactgtgctgaattttaagatgcgatgtggtgttgttgttttgtctttttttatgagcagcatctttattataaatgatctatttttatgtctgtggtgatttttataatactgaatttcattgttgagaacaatgactgtagaaagatctttctttattgttcctgtctcttctcccagtgtctggaagaaactgttgcttgcaaaaaacatagctaattaaaaattgaacttaattagctacaaagaagcccgactcgccagggctgggaggaagggcagataaagctgccgacgctgtgttcttctttaccttcgctttaatggtcttcacagcacgtcgtgtttatgagtcagaggaccctagagcgacacttgttggggacgggcaggacaccacagcacgacaggcagctcctgcaagtggcggcgggaatgcacgccggagtcggcgtgccagcgcggtggaaaccggttctcaggttctggccgagtggacttccccttacatcagcgggccagctcctgtcaggcaggcggccggcgattggccgggaggaggcagtcattcaaactgccttttgtgtttggctaatcagggcagcccaggttcccagcggaggtgcgtctgtggtgtcagacacctgtgtctcagctctgtcttcctcgggctggctcctgcggatccttcctgggccagaaccgtgcctctaggccacctcccccaagccaccaagcccccgcggtgggccagccttggcccagtgtcacgcaggacagaaatgaccaacagataactgaggacaatggacctgcctgggcatagacttccttaaggtaagtccattttaaaccaacgatttctcgatgacattatttctccgtcgatgttggcagaaatgccagcattgggaaggtaaactaaagagaggtagggaagttgttcaagttaggcctttgtgatgaaatcaccaaggttttgggctgtcagatatgctgacaaaataatataaaagaataaagaaacatgtacatggggaggagagagcttgacaaatgactctagtcctctcaggcaacgggcactttttcctatttgatgagaagctcaaatgataacagagtaaagtaacttttagttaaggccaacaaatatatatgctaacttgtataataagaccaagtcagcctgaacatcttggctccctccaatcatgcaacctcaggatttacagcctaattttaattataacttatttttaaagctatctttaactttcttatttgggatatgaaggcagcttttcttttttaggtttgttcgacatgggtgaatcaatgaattgcacttcaacagcaaaattggattgtattgattggttggctcactcttctcatcctttatgtttcagagaaggtcggattataaatgcaagcacctacatttaagcaacagttgagatgcttaagaacgtgcttctgtgtgattctgattaatccttaactatgctctgatttcattttacttgtaaatcaattgacacatacttcagggaccatcctgtcttttctctggggttgctgtcaccgtatttgtaacttgaggatttaataattgaagattgataaaaaagactggtggtttgggactagtgttttcaccctgtctgttttgttgtgataggaaggaaggtaattttcccttggatttaaatttttttcattgaaaacattctgaaaatgggtaaagttctctttataaatctaaagaggttctgagactacttttcccacctcattaatttcaaggatgtaaacaccttcatgaaaggaaggtgtttacccattctcaatgattctgttcaagtgataaacagcaatagggcaaacaggtcattcaaaatctgtgctaatcatcctcaagtgtgttttttcttccaatgattacagccagttggagttttccatttttttcagcagttagctaaagtgtctttataaaaacattttcctataataaaataacacattagtgacatttaatataaacataaaaattactgctttgatgaataaaagcaccagaaatggcattacccatcagatgaaatatgatcatcacacaagtctacagcaatcacttaaaaatatagtgtatatgcaagtgattttaaaatatggatccataggtaggtagacacaaagtgaatttataaatgttgaagttgttaaagagaaatgaacattggaaagctaaatagatattgaacatttttatatttcaaaaatctaccttcggttatgaattacaacctagagaatatataaatcaaaggtaatttcctgagttaagtgtaaatcattttttgtatggagagggataaataccctcatcttattccctaatcttagccctaatcattgtcttccataaaaaccccagtatcctaaaaaggtacagaaaggaagaggagagagctggttgaaaaacttcttaacaatacttaaaagtaaacaaagtcacaaaccccacgtttcatattaagagtgtagaaagcccttgttcaggtctgcagagtaccagggcactccaaatatgtaatttaacacattcattaataactatgataaatagatattttattccaagaacaatatcattagagagttagattggagggcaaggggattaagtatcttaagtttattgtttcccgagtgaccatttttaaaagcctccttccaggaactgtggaatgcctgccaggctccctgactgctgtctggtgagggtccctactggtgctgtggacagcacaatacacaatggggcacaagaaagccacgcagcctccccctcctagacacatgctgtgcacccccttggctctgcttggaaggttcagctctgcaaatggaaggttgcaaacatcagacaccttctttctgtttctgtctctctccccttcttctccccacagtgtccagccttggcccctgacttttcctggggttggggaggcctgtaggttcagaagctgagcagctgggtgaagacctcccttagctcaatgtgctctggccatagggagcagacaagcaagctgagtttgggtagccctagacacatggaaaaagaaacagcttcctcacctccacccctccatagatgacttcattaaaatgtcgctggttaatagggaaaaggtagcactccttgttaggccaaacccctaaaaggcatgttttttagaaaacaaaaaataaacaaaaaaaaaatccccagcagtcttaatgatcacattttggtgacgggtgggaaggtatactttcatacaaatggatgattttggaaggcatgaacctaagctgtctcacacaattttgcttcttagttggactgactggtttaaaaaatgaagcccaaatgatagccgcagagcggtatgggtggcatatcatctgatcccattgagataaaagctctcaacaaacttgtgtgaaccaaaactgatagaatgagtgatgttccacaagtgatcaagagactcctagctgggtgcggtggctgacgcctgtaatcccagcactttgggaggccaaggtgggcagatcacctgaggtcgggagtttgagaccagcctgaccaacatggagaaaccctgtctctactaaaaatacaaaattagccaggcttggtggcgcatgcctgtaatcccagctaatcgggaggctgaggcaggagaatcgcttgaacccagaaggcggaggttgcagtgagctgagattgtgctattgcactccagcctgggtgataagagtgaaactctgtctcataaaaaaaaaaaaaagaaaaaagactcctggcatcagtcactgaaggaggactttgcttctgcactggaagcctggctttaaagcaaaaactctggtgttggaatgtaaatgagccccaccctgggaagctatggctgctcagaaacacttggttttttccaagtaccaaagctccctagtaagcagtagagctaccagtagactctgcccactaaaacatgtgttccacattgcccatcagccctccaggggcgggggtcccagcaatcagcctctgaagggaatctccaagttcttcccttatctttactctcacagcagtggaggcacagtctcagtgacctgatacttatgcatttatttctcagttgtttattaatcgtggatcattagttcttccatctgaggtaggtcatatatcattatcctagtgtggaagagagagagaaaaagaatgaaatggaagaatttgtccaacactaccaagaagttagtgagaaattagaacctcaaataccatgcggttctccttccctttttgtctttctgtcaaaacggaaatcagggatccttaaacctttccctgagcagttctctctgggcactaaaatgcttcaggccaaaaatatgctggttctcttaactggatcactctgtgactgaaagagagagcattaaaacaatgaaatgaattgggtgtgtgctcacctgaacaactcaaaaccccagcgggttgctggtaaagttttcctgaagcctaaattgaggacagcaccctctctcctctggctttttcctagaaagacctgatcatttagtttataacaaatttcaaccctggccccttgaccagggaggccagttgcgggtgagccgtctgaaggtggctggcctgcattgcctccgaaggtatttcaggaatgttaatggtatgcctgagtggaggccgcagagctccgagctcaggcctgagaactgttcttgtggccatctgttgtggcccaggaagtctcatagcaacagcttctcaagaatggtgcttttttttttttttttaattaaaattaactcacacaaaaccaaaaaactgctccactgctcaagaagaatcaggacagcattcagattttttctacacagtgatgagtttttaaggaagaaaagcccccgcatcctacattcctgttctttaaatgagcaatttgtacttggtgttgaggtcttaattttttttttttctcccccggggtagaagtctttctttggaaaagaatggaggtgaaaacaagtttccaaggctgtggagaaaatagtcagcaaaaatatggttaggaaaaaagtggtcagtttttttgagattttcttggtatttgttgttcttagcgatcctgtcggcagctgcatttttccccctctgtaataatgtgagctttatatgcctggctatttagttagtgaaatgaacttcagacaaagacactaattttaccatgatgatgtatgccctccggtatgaatatcgaatctgtgcaacagctgacctcagaaaaataggtagggaaagtaataattatagtttcatattttttcattgatgagacattaagttagtcatttacaaaaactgaggtttttcctcaggatagaagatactgtaaaatgataaatacatgaagcctgggcaggcatgccagacagagacaaaagaattctattctgttccgcattgtaccccttaccaggctatttcaggaaggcacacggcctgtcagagcacagtgcctcatctgcaaatctgattcctgcattgttaaggaggttaaatataatcacctaaaaggaacttgggaaaagatccttgaatctgaatggcgtctataaagaagtattatacactgtcattcttgctgtggcacaaccctgggaaaacattttcatgagaacttttagatctccttcactttttagtttggcacacttccctcaagttttgtgacatgaaatttcccagaagagtcgcaaaatattccaagtgatttctgactattattacataattcctgaatatgcaacacacttggaatacttctttatattcttgattggtagtgtgtattgctacttatatattattcagatgtaatacattgcccttagtaatggcgccaacctctatttacgtgttatttagatctattacattgcccttagtaatggcgccaacctacccggaaagggatatgtacttcaagttttgtttctgaaacacaggttcctaatgacgtttttctttctataaagtcctgactcataccctctttgtgcatattgcctcccatataaaatataaccaccacatatttaggaagtgcctaccatgtatcagctgggtttctaggtaccgagtttggagctgtgaataaaagtagacaaaaattctggcacacagtctagtcaagtgacacaggtaacaagtcagataacacaaaaataagtcaattgtattataggctagaaaatgataactgctatggaaaatacataaagcagagaagtacatcatataatggcagagagcgtattgcaattttttagggggtggtggaaggacctgctaagaagatgatatttaaaagaaaacttgaaagaggggaaaaaatgagccttgaaggttacctagggagcattgctgacagagagaagagcatatgcaaaggccctggggcaaacgtgtttgggaaagagctgggaggccagtgtgggtggagcagaatgtggcggggcagagagacagtgggtcactgggaggcagttagcttttactctgaaaaaatcctaggagaacttgcttcacagagcagttgtgagcattaaatgaaataatttgtgtaaagccttctatagagtgcctagcacacagaaaatcttcggtacttgttagctgtcatccatttgcttattattaccactacatagtctaggatttaaggatggaatgatgtgagcacacagcacagagctttgttctgatcaaagttaattgtttcttatgagaattaaactcccaaccttggcctcttaaacattaaattctatcagctaagaaggttccaagtctatatcgtcacacgtacagagaaaaaaagcttgcttttaagaaattggccctgactaagctaaatcgttgtttccattttgaaagtaccaagtccatgctctctagggacaggtgtattttgagacatttgcttccaatttcagctacaaaagtcttattgaattccactgaattcgcatgatctcacaacgtactcatgtttgagttctgatatcaattcccttttctaggcagcaggattcgaggtagggaggagcatattgcagatataatgaaaataaggagtcaatgtgcttttcttctccccacagtccagaagcaagattaccttttgaggcacttcagtgaccctttcttaaaatgatcttcctggacacccctttgaatgtctagattatgctgatctcctttgaacctgagggacttgggtcataacttatgtcgagtgatgactagctcaggaaattagaacaagacagggaatccttttctccaagcatatgaagaccatcatttagagtcagggatattcttgctctagaaccaccataagtgatttgggagcaacaaaaggaattattgatgataactagagatgctgaatgaatgaaaagatctgtctaaaaatgtgcaccttcatcactggaaatgcttcaggagaggctgattaatcaatcaatagtcagaggggtttgagtttatccacacgacatactaaaagaagccctttggggttaagaaataacccctagaggatttggcatcctaccagagatcatgtaattaatgacccagaaaggtaccatgtttttacctcttcaacccaaagacagtaaagaacacagatgatataatttaatataaatctgaaagaatgataaaaccacccacgatgactggccctgttatttatttagttggtcaagttctaatattttggcttcacaagttccactatttttgatgacatgtgttgtatatttttagttgtaaatcagtaatctttatggcattcctctaattagtaagcaaagtaaactctttttaaaaatttgggtgagaacttgacttctaagatcccttccaaatttgtgcttctgcttcatccttccaagatctgcttattaaaaaccaaattcttcaggaaaagtcaccttagtttaggaattctgagagccagaagcaactgattgtagaagccctatttcacttaggggcagtggctagtggagtcattttcttgcagtgtcaccatggtcctggtgcccggaaccccagttcccaacaccgatgatgctgtgttcctgtttgcagtttccaatattgtcacatcgctactgctggctgccaggttgctcggttatgatcagtgggcagagtggactggagctgttttttcttttggaaaaacatttctgcagtacttattacattctcagtgatttgcaaaaatgctctctctcttaacccaatgacagagctacagtttttgttcccatttaacaggttaaacaattgagatacagggaactaatccaaagtctcacagtgacagggacttgaacccaggtcatctgtcaacagagtctgtgctcttagctgctacattggatttctcatccacaaaatgtctaatcctatgtgctctttttatttgttgtagctctcctgttgattcagagggaaaactgatatggcatattattacactttattgccctctgtgagggcagagaacataacctattgataccagtgcctagtgtagcgcctggtgcatgcagatactcaaatatttgttgactgagtgagggagtgagggtgtgacatgaataaacaatagtaaggccatagaaatgccatcctagtctcaagagtcacagagatgtatgtaatcgcaggatgtcacttacataaaaactttaactttgaaaagttaaaaaacataaaattagaggtgaggacatcatgggacaattacagtgtttgaaccagtgtcaacaatttcatcccttgttaggcactcattcatagtttaattaataaatcacattgcattggaagtgtagctccaaaggaccctgatgtcagactaacacctgctatgtgacaattggggagggaacagggaaccattggaacgccatgaattccactaaatcagtgcaaatctggatttggtgcatttaacaaatggacattgagactcacagatttgttatggagtagagaaaggaagcctgaatcttgacaatgccagtatctaagggaacatttgggtgtattgaacataaacccactaagaccaactcaaataaaaagagatgaagatatcaagatatgaaggaagcttgtgaaatccaactataggaagccaggaacacctcaacattaacttagtggtgaaaagctcttagagtcagaaggcctgcatgtgagttccaaccttggcattgctgaatttgtgaccttggataagttacctcatatttctgaacctcatttacttgtctaaaaagaaggaataatcaaagtttctaccttgttgtgttgttgtgtagtttcagtgagataatacatataaagcacttggaacactgcctgacacgtaataggaactcagtaaccattaactcttattattatttagaaagtaggcagctattcactttctttttggattacatagttgttcatttcagctgactttgaacgtcagttccattgctctgtctgcagactggctttctgacagacatggtgccagggttaatttaatggcatggtgatgtcatcaaagctccaggtttgtctgtgttttcattctgccacccttagcatgatgattttcttccttacatttgttcctcatggttgcaaggtgtttgctgcagctccaggcatcacgtcctcacagagtcttgtccaaacaagggaaggagttctagttttgtgtatttcatcaagaatgagaaatactttttcaaaaatcctcctgcaaactctctttttttaggagtcagatctcattagttaggcttatgtcctatatccttgcctacactagtaactggcagggagtcagattaccaagaatagtatagaccaggcatggttaatcccttagggtgatgaaggagctgcctttctgagcacatcattatctgatcctgcaatggaatcaaaattatacttgtggagtaaaacaggggacagtaaccattgagtaaacaattatgagggcctgttttagataagcaagtttctaagccaggcaaatcagagtgtttctttgtaattttatctttttgtacatggagtctaagaggaggcagaactcttgcagttgttaatctgggataaggtaaacctgaagttctctgctccatggttgttttctgtgtactttacccctgcatgcacacacactgaatcctattgcaaagataaaagtgaggtcttttttttcaccttgctctctctgtctatatactgtcatgcaccccataataatttgggtcaatgatggaccccatgcatgacagtggttccataaactgataatggagcatacacagaagtgatatatagtacttgatattatccctgcagatcaagtaggggaaatgtttgatattcagtaatgtgctgggacattttcatatgaaaaaatagagagccaggtgtggtggcttgtgcctatgatcccagctacttgggagttagaggcaagaggatggctggagcctgggaggtagaggctacagtgagctgtgatcacaccaccgtactccagcctgggcaacagagcaagaccctgtctctaaaaagaaaagcaaaagatgttgtgtataacatctgggtttgtgtaaatactgtctgtgatgtttgtatgatgaaattgcctaatcaggcatttctggtcacatatccccatcattcagcaatgcatgactgtgtctagatgtataggtaggtagataggtacagagaaacacacacacacacacacacacacacacacacacacacacacactctccaacagatgctgcctctcccaaggaagaacctgacaataatttccagtccctgaggccatctccatccctggccttctcaagaaattcccatttttgcttgattttctctgtgggttcaatgttactgtgtcatttgcaacaacaataacaaaatcccatcagaagcattctcctaagcttctgggattctgtcccctacatctactagtgtgtggccctggctcaccccggagccatcactgggctctaccccatgtgccccacagctctagagccttatcacctgacactctcagccttgccccagcaccaggtcgcaccagccgcaatgtgaacagctctgcctatagctgaggaagagctggtctagcctcaccccttcaactggggcttgatcaggacctgttctcctagaatagacggcaacggagagacagtaacctctgtctctgataaaagggtgtaatatctgccaagtctttcctaaagagactcagcaaaagagaccaccctactgacaagtacatgtttcataaataaaatgactttatttcagatatacaagtgcctttgacagggagtttaaatctggtggctgtattccttttggcctgacttaaataggagaagagaattgtggtttcctatcagtgggaaattagtaaaggattcgaggagtgagtgactaggagagtagagtgaagtcatagacaaaatcaatgtggctatcggggcaggccaattggactcatgagaaaaatcccttggaaggtggaaatatgagacattgagactgtcattcaggaagtatggatagatctttttttaatgtttatttttactattttgttatgaaagtggcataaacatttatgagagtagagggtcccacaaattcccacgcacccaccctccagctggatggctcttgttaagtagaacaagacagggaggaggagaagatgaaagaaaggagcaggagccagtgaaggacaaaacgttcagtgacagatctattagtgaacttgtcaagagaggacaggaagctgaaatccaagatgtttattcttcttaatcataggttaatgaaataattgctaaatgagatctggcttctagcgatctgagtagggattatgtaacttgaggaagcagatcccgtgttgtaatctccaaattgctgagtgtgggagaaccaaaaggctcccatctaacacggtgacaaggctaagacagcaagagtcagtgtttatttgtttggcatttagcaattatttttctacaatctcccaggcactgtgctaggctttgtgagcatgcaaatctgaaggaccaggttcttgctttcagagaatgcagcatctactggtgaaagtagatgagaaaaatctatgactttttttttttttttttgagatggagtcttgctctgttgcccaggctggggtgcagtggcacgatctctgctcactgcaagctccgcctcctgggttcatgggcattctcctgccttagcctaccgagtagctgggactacaggcgcctgccaccacgcctggctaattttttgtatttttagtagagacggggtttcaccgtgttagccaggatggtctcgatctcctgacctcgtgatcagcccacctcggcctccgaaagtcctgggattacaggcgtgagccaccacacctggccaaaaaatctatgattataacagtcatgctatgatgaagcttttctggcagcatagaaaagatgaaagcttcttgtaggaggatgattgtcttgatctttggaaagatgaacaggcatttggtagatggatttagtgagtgaagacattctagctagacaaagtagcttacacaaagacagagaggtactcaaagagaaccttaagtcagggctgcagggctgatggcacacttgtgacctgctaaaagtcaaggtggagatggggtagaggtggccaggaagtggggagcaggggctaaaattcagcccgtgcttcgccccctggtgcagctgtatccacctggaggaggtgtctttttctggtttgacaaggggccacgtgggcagggggtagccctgtctgagtgtatttagtattctttgactaaagagtgtatgtgaggatgctcatgagtttgaacagaacccagaaaggtgatgggacattaataaataattaaaaggcagagtagtgacaaaatcggacttgtgcttacgaaagaccattctggctgcattttgggaggtggttttcaagatgttaagtctgaaggaaaagaaactagtgagaaaaggctgctccaggtgaaaaataatgggggcctgaatgacagctgtgggaggggaaggaaaggaagtggtgcattgaatatccagaaggtacagcaggtagacttggtgacgggctggctgcttgggtgcaggggtgcaaggcgaggaggatgactcctagggttttagctttagcagctcagtgggagattatcacatccccgtaaagatcaataaacccaagaactttgccatagtgtgtgctgaggtgttacctgttgaataataacaataaaagcgttctttatataatcacggtggttaaagagtaagaggagggcttcagtagtagcttttgagacagacgaaaaacaccttgatccttagttgtgtcccttcagagaatgagcaattgatatgaaaggaaactgtaggatcttttgcgttgtgatcccattcaagcacagcaaaatcccctgtagtggataatctgcccattcaagataggtcagagagtaatgcccagctgcagaaagctagttcatctcctttattctttctttcaagatgaaaataatataaatctagggtatcttaaaccctttctcattgtttttggagaaagcagttttttgttttgtttctgatggtggacatggcagcagcattctttctgtctccctgtgctcatcatgacggtgtcctagcacaggctttgaagttgaatggtcctgggtttgaattcctagttcatcaccatctgtcactttgggcagaatacttatctctgtgaacctcatctgtaaaatgtagggaaatacagtttcctcatggagctgttacgagggttaaggaaagtggagtgcttggcataggacctgcaggccacatgctggtcacaagtggtggctgtggaaatggactttgttggtgctactgtacttgttattaatgccagtgttcagatatcaagaaaagatatggcacctggaatcccagcactttgggaggccaaggtgggaggattgcttgagcccaggacaacatagcggaccctatttctaaaaaaacattttttttttaaattagccaggtgtggtggcacaagcctgttagtcccagctactcaggaggctgaggtgggaagatggcttgagcccaggaggtcaaggctgcagtgagccatgattgtgccactgtactccagcctgggtgacagagtgagaccctgtctccaaacaaacaaacaaacaaaaacccaaaaaataaacaaccaacttgcttttgcagcctttgattattccttgggcctgcatctattagatgctgattgtatatcacgttgccttctttatgggttaacctgaggagaaagagttccatgccacgtgagtcaaagagtaggttatatacatggcttgctccttcctgatgtgtcttgagatactgtgctgattatgcttgggacagagaagcataccattagactattgaaatcactggaaagaaagcagaaaactgtggtactttcagctttcacatgatcaaggtgttttcctaggatacaataggccactgaagctacacttgatattacattaataattcaataaagcacattaattaactaccagtccatggcttcagcagctaatagcacctaaagaaaatgtacttcaactttcttatcaagaaatggtcttgataagagaccgggtgactgtaactttggtcattgctctggaatgttcctgatggtgctgccagttttcattgcccataggtgcaatatggaaatttttataaatgctctcatttgatgcttttacagattaacaacatttttatattgtattgtaactgaaaacaaacgagtatttttcttatctcacctgtagaaaagggagtggtgagaattcaggagttaatattgtaaaaatacctgagataagaaatacatgtttaagtattactggttttgattgccactgaatcctcatgaagcaaccacaaaaatcaaacagaatcagggactaggaaaagtggaaagtctgtatttttatactactctaaaatctattaggttggtgcaaaagtaattacagttttcgcaattactttaacggcaaaagccacaattacttctgcaccatcccatgcctttgagaaggaagataagttttcagagtgtttaaaattagccacccatagtttgctgtaaaacagaaataaaatttggtgacagttaaaaatttacatcagtggttctcagctagaggcgatttccctccaggggacatttaacaatatctggagacatttttagtagtcacaactgtgtgtggtgtggggagggggtcgtgctactggcatctagtgggtagaggtcagagatgctgccaaaatcctgcaatgcacaggaaaggccccccagtagagaattacctggccccaattgtcagtaatgccaaggctgagaaacactgagttaaataacagctgttgggagcttctaccactggactgtctctttcagcaagaaattagccatcctgttaattgaaattattttcctcaggttatgtaaggaaaatatactcctttgctttcttttttatttatttatcgtccaggctgcagtgcagtggcgtgatctcagctcactgcaacctccgcctcccaggttcaagcgattctcctgcgtcagcctcctgagtagccgggactacaggtgcgccaccaagcccagctaattttttgtatttttagtagagacaggatttcactatgttggtggccaggctggtctcgaactcctgacctcaggtgatccatccaccttggcctcccaaagtgctgggattacaggtgtgagccacggcgcccagccttactcctctactttcttataggtttagtctggactatcttctttatatatagctctcaaattgtcagacaattcagtccccaaagtcctcaggccagatgcttgaaagattgtgactgcaaaaaaacaacaaccaggttgattcaagggttcacttctcagctgattggttcagcactctgtggacacacagctgttttgtggtgataaagagagcagaagaacgaagttggttgaggaaatgccttcacatttcaacactccccttcaaggaaagggaaagctggcttttcaaatacttgccaagtgtgaagccatccaggagcaattacagaacgttcctttcaatctttctcctctgttttccttgacttattttatgaactatttattgaatacttaccatcccaatccctatgataagtactgctcctaatacaaagaaaactcaaatgattttaagaataactaaaaaaaaattacaaagtcctgtaggtcatcacctacaggaaaaagaaatgttggacaaaggatttctctcctagattttatgtatttatatcttacaacatataaagttaagtccacatttttctatgcatttgtctattgaaaactgttaaaatacagaaatttataataaatgatacagccatatgttaattttcttgattttttttttcgttagaattcttttgctttatcttgaaagattacccagttctggggcttactagtggcaatatattgatatatagtaggcaaaattaaatttaattacaataaataaacttcattatatgaaataggttggtgttaaattggatctctcttggtccagccctaggaaaacaaattacttttcattatgataaatgtgaatgtatctccagatacttcagtggaactcactgtataaatacgacagaagagttaggaaggtggaccctggagccagactgcctggattaaaatcctggctctgccactgacactctgtgaccgtgcaaccttagacagatcactttcctcctggtgcctcggtttccttatcttcaaaatgaggataacagtcatagtatttttcttagaaggtgattataagaattgaatgagttatgcatgtaactagcacatagtaaatgctcaagatacattatttttattgtcatcattattgttgcattgtattttatttttctgtatttgtactaaagatggactgatcgatagacccattgcagctttcccaagtgtaatgtggtataaaggcacttaattctgattccacatgttcctggagatagttatcttttaaaaacacatacttggctgggcgtggtggctcacacctgtaatcccagcactttggaaggccgaggagaacggatcatgaagtcaggagatcgaaaccatcctggctaacacggtgaagccctgtctctcctaaaagtacaaaaaattagctgggtgtggtcgcacgcacctgtagtcccagctacttgggaggctgaggcaggagaatcacttgaacccgggaggtggaggttgcagtgagccaagattgggccactgcactccagcctgggcaagagaatgagactctgtctcaaaacaaaaacaaacaaacaaacaaaaacccacaaacaaaaaaaaaccgtactttgcaactaacaggacatctattgattgatttatgatcaaagcctctgactttctatgtagtatgaccatataaagtaatggaataagaccaccatcttgtattctttcttttcttcttcttttttttaatattttaagttctagggcacatgtgcccacatgcaggtttgttacataggtatacatgtgccatgttggtttgctgcacccatcaactcgttatttacattaggtatttctcctaacactatccctccctcagcccccaaccctgcaaaaggtcctggtgtgtgatgttcccctccctgtgtccatgtgttctcattgttcaactccccttatgagtgagaacaagcatcttgtattcttttttttttttttttttttttgagatggagtcttgcactgtctcccaggctggagtgcagtggcgcgatctcagctcactgcaacctctgcccccctggttcaagtgattctcctgcctcagcctcccgagtagttgggattacaagcacctgccaccccatctcttagtagagatggggtttcactatgttggccaggctggtctcaaactcctgacctcatgatccgcccacctcggcctcccaaagtgctgggattacaggcgtgagccactgtgcccgactgcatcttgtattcttaagcctgtagagcatctcagtcttcaggcagccaaggacatttattagaattggagcctctggctgccttggaagaggatgttttcaacacttttagcctgttgtaatacttgggggctactggttgattgtgctttaaaggatgttgatatcaaatatggtctggctatatttatgccaagttgctgacatgttgtataatatttattgttcctaatgcatgataggatcaaaatgctgtacacaaacaggtaaagatggttttgcagctttgggttttcaatttattttctagaacatgtctcacttgctttcctacataaagacacatgattgcttttgagcttaactaaatttagtgtggtatctaagttgtctgtgtgttattctggtgaacaaaggcacttgatcaaaatgatctcttcaaagttggaatgccttcattaaaatgttcaaatggtaaccgtccacctgaaggatgccatgaaaatattagaaatcattgttttttaagcattgatgttgataattgttagacaatgtctgaaacttttgaaatcacaaccatctaaggcagtataggaaacagaaatagcagggatgttgaaacactaaaatagtaagttttgtaagacaaaagtgaccttgcgttcaaaataagatttctaggaatttattctgttgattttagattgaatttgtagtaagtaaacaattagctgactatataaggctaaggagttacttatctatgaaaccaaaaatgtgaactagtttatctgtagggtccattttgtctctaaaatgccaaaaatcaatctaatatatttccctggattgaattcctcaagggtcaaggtgcatgcacctttgatatagtgctgaatgaagcattactaataaacattaaactgatttggatttaaatacctcttacacagctcaaatgcaggcttgaaaagtaatgtccccatggcggtaaaagcatcagtatgagtgtacgtgtggaaagatttgttgtaggaagatcagtcagccctatttcatgatgacttcaatgttgtcggtgcagcagtggagtcatggccatgacagcatcatcagagtgaactttaattaaaaacaagtggagaaatcaacagctaggatttgcccgggaaatacctaaatgacatacagcccggaagaggatttcgaggcaccattttattgcattctagtgggagagaacagttctcattataaaaattctaagaaaagttggaaaaataatgagcaccataaattagatttgaactaggcatgccttttagcctcaacacatcccattttgtatccccttaaactgtcagagaacaggcaggtatgactcattcctctaacttgggtaagcagaaattaaaataatcctatttaagaaataaatagcaaaaaggaaactataaataaatggtcaaatagaattgcttagttgttgagagaactatgtaactcagctaagtgacaacaaagggaaaaaacctaattaagttgctgaagagggggaaaatattttttcagtggcataaatcccagagcaaaaacaaaaacagaaaaaatgaaaagatgtatgcttttaaatagatggaaaaaatccttgttttctaaaatgtgaccttaaagacccttggtagaaattctaatagctaccattcaatttctttctataacacctttgatacagaatcactctttatcatttcatagttccaaaaatgtattaaaggcacaattttctctctctctctctctctctatatatatatatacacatatatatatacatatatatacacatatacacacacacacatatatatatatatatatttttttttttttttttttttttctgagacggagtctcactctgttgccaggctggagtgcagtggtgcaatctcggctcactgcaacctccacctcccggattccagcgattctcctgcctcagcctcctaagtagctggtattacaggcgcctgccaccacgcctagctaatttttgtatttttagtagagacagggtttcaccaagttggccaggatggtctcaatctcttgaccttgtgatctgcctgcctcggcctcccaaagtgctgggattacaggtgtgagccaccaaatactatatattttaaacaaacaaatacttttaagtgttatgcttactaccgactgctgcttaccagtgtggtgcatgttagctactctgaatgttggttttttatctgtaaaatgatagtaaaggctgggtgcagtggctcacacctgtaatcccagcactttgggaggcgggtggatcatttgaggtcaggagttggagaccagcctgaccaatatagtgaaaccccatctctactaaaatacaaaaattagccaggcctggtggcaggtgcctgtaatctcagctacttgagaggctgaggcaggacaatcacttgaaccctggaggcagaggttgtagtgagctgagatcacaccactccactccagcctgggcaacagagcaggactccctctcaaaaaataaatacatacatacatacatacgtacataaataaataaaatgggagtaaaaacctttacctctagagttcctgggagtataaattacatgcattatacattaaattacatacatagtattgtactgggtagctggcaggagtccaaaaaatgctgtagcagcttgtagaaagtggtcttggtatgctaaactctactctgactctgacaatttccatattttttaccaaatcagcttactgtgcctcaatttcaaaatcttcaaaaatggcagtgtgttcaaaaactgtgtgtgtgtgtgtgtcatatttatatgtatgtgtgtgtgtgtgaaacatttgagatttgcagtgtgctcaggaatataaagcatcttgggaaaaaagatgccattcaaatacaaacaaatactcatcatttcctccagttttattgactaaaagcatcagttgcaacatctcaaaatctgatctatttctgttttatggaactaaagcttgatttagtacatattttgtggtccttctgggtctaggagatgaacagactgaactggaaataaacaaagccaagaatcttaagctagagggtagagacctattcactcccacactctgaggaatttatgaccagtaagttgctctctaatgagtacagaacaagagcattgcatcttctcttaattagtttgacagatattcatttaaatttgaaaagattcccagacgtgggatagcaaaggaaagtcttgaattccttttgcatcttaattctgtttttgttatggtggctctggggaatgtcaatatctgaagacaaataaaaactcatgtcttcatccagggacctccgcattttctatttattactggccacaaaccaccaggtttcagtttgcagctgtaaagtctaacacaaaagcaacaggttctgcaataatgctgttgggcctggtttctatgaggggtgcattttttttttcttgtggttaataaaggacagggtttcaaggcaggctttaaatagccatctttacatcaaaataagtcaccacgtgggcatcatgaaaccatgaattgtttttacccatagggcatagttaccactagcccctggtaatccatggaaatgagtaactgggagaccttatatactcccaagccattttaatcagtagtaacattaacctttatgaaggttgttaaaatatagcaagagtgctgatgacttacttcactttatcatgctttaacctctagctgtgcaggctgttcactccaaaacagtgcccagttaggtagcaccaggggcctgcaacccacccctacttcactggcctggccaggcatctgtgaggctgactacataggctgagggatgccttctcctcctgcaaacaaagaaaagcctcatatgggctggttgtggacttgactgaatagagctgctattgaggaaatgtccaagcatacacaaccttgggaagaaggcacaacacttgcctaatctaccaaagcacagtttttagctctcgagggagcgcattcgttcatcagtgagcctggtccagcttcactttggcaagtgccccccaccctgtctctctcccctcactaccattttccccattaccttagagcagattccttttactaatcaactcatcttaatgaagccagaatgcaacattcaaggaaagttctgatttaaagaaaaagaggcagagcttgcaaagcatcacctgttgttctctcagtccattggcctggtcattagattatactctccggaaagctgatttgattgattggacagagatggcatagcatagcatagcatagcatagcatagcatagcatagcatagcatagcatagcatagcatagcatagcatagcatagcattggacagagatggtatagcatagcatagcatagcatagcatagcatagcatagcacagcatagcacagcacagcacagcacagcacagcacagcacagcacagcacagcacagcacagcatagcatagcatagcacagtgtcaggttagaaggcctggggaaaacccctgctttaccacttagtggaataaccttgagcaagttacttcatctctttgagaatccatttctccctcagtaaaacaagaatgataatatgagacttgggtgagttaatacatgtaaagtgctgaacacttgctatggaaagcagtggttctcaaatcttgggccctggaccagcagcattacctgggaacttgttagaaatgcaaatctcaggtcccaaataaaacttaggggtataggagaaaatacttgcaaataatatgtctgacaaggtgttaatatccagaatattttactaagtgaattaggatatacaattaacaagaacacttctctaaccattcaacatttaggaaagcttgtatatgtttataatttcctgataactgaatggagaagtgcagttatttcatttctggagtatacattgaaccttgcaaattcaagtaatctttttccaggcctctagtacatcatagtccatatagacaatctgttttggtatgtttgtttgtttgtttgttttggagacaggatcttgctctgtcagccaggctggaacacagatcacagctcattgtaacctcaaactcctgggctcaagcaatcctcttgcttcagcctcctgggtagctaagactacagatttatgccaccatgcccagctaatttttgtttttgttttggagagatagggtcttactatgttgcctaggctggcctcatgagattctcctgcctcagcctcccaaactgttgggattacaggcgtgagccattgcaactggccctcagaatctgtatctgaccatgtttctcttcaggatcagaagtctttaaaaaagaaatgtgaaaaaacaaattacgttgtaaactcttagtttcctttcaaatgaccccagtctatcagaatagactagatgttaagagcagtgttagcaggcaattaagtcttttgtgcccatccaccacttcctaacatttacctaaatagagagtctagaatatcatgtttacaccattatgtattctgtctggaagtaacaatataaaagataacattaatttactttttttcagtagatgctactgaactgtgaacatcttattaggctcgagtttagattttcaaacttgtctcaggaagctgttgctacctggtacccattttgttttatttttatttatcttttggaggacaaggagagaatgactttgaaaaatctcctgggcaagaaaggggaagacttttctgcaaggaaaatggattgtactttgttttccttcataaagggtaatgaggatataatctcaaagctacgcttgaccatcatctgtcaaaccaaagcaaataagccagtgcctgtctttccttattgtaaaactaaaagagaagataaccaccatgtggcagttgtctagccaaaaaaaatcaccctcatttcagaaaatgtttactttttcactctcattgagtgatatgccatcgaggtatgagttagatgttggcattttgtggaaaggttttctttgtttagcaaaatcacagctgttcatttctggtaattttgaatttcctaaaaagtggccatagcttcagaatttgatttttagtaacctttagcagactgagagtttttctggtttgaagattatattgaaacaccaaaaaaaagtagagtggtttgtgttttactttatgtattaatgtgaaatttggagatgaagcctcttgttgctgaaataactgcatcccctcgtcttccgctgtccacttttatatatttcctaaatatccacaaatcttgatacactcttgtagtgatttgattcttgttttgttcatatgtgtgttttttccactaatgtacacctttgggaatccactcccagcctttccatgatttcttctgtaatttgggttttatttttaaagctgttggcatccgtgtagagggatcctgccgttacccctctccagatcttaaggttatctccctattctgttgattgagagatccaaagtcaaaggtgagtcagggatttcgtgtgcaggttctcactgatgaacatgttttctccagacccagctggggggttaagattcaggcaattggtgacgagaggggctgctttcctccaagttcagtagccctccctcaaatgagaaactatttcacaacaatctcaacccatttgtcctccactgtggatagggatgggggaggggcttgcttgaagagttctaaggtgatttttttcccattaaaaaaattgcagtaaagtatacataacattaaattgaccattttaaccattttaagtgtataatttggtggcattaagcaccttcacattgttgtgcaaccatcaccactaccaatctttaagtgagttgaagatgatttttttaaagttacttcttgcctcagctcccaaattccagttgactttgtgcgccctctctctgtgtctctctctctctctctcttaaagtctgcgttctcattctgattatttaacttggagagtgtgaaggattttttttttttaacactgcatgatgaattggtctcagtggaattcaaacgatctcgttgttttggttatttcttatcgggaatgctggatttttttctaagagccatggcaggggtgaaggggcacaagggagccacctccttttgagtcaatttagcaaaagtgagaaaacggtggggtgataggaagtcattcctggatgctaaaggggcatcctggctccctgaagaaactgagactcccagtttttacgtagtgaactttctggctgtaatttagggcaaactccttactgtttttatatttgccctccattgataagaacttcttaaggtcacagtgtccttgggtaatgaagctaggcagaggaaagttctttaatatttacctagtgtgcacgccataccaggaactctacaaggaaacacacggaacatgcccagcctctggatcagcctgacttggggagactgcccgtcaggcacaccctgtgctggctccagcttctggagtttctggcgaatcatacctgaaaggattatcatcttcacccagtgtccggatcatcagccatggaagtttgtttgttcaacacaggctgaatcagttccatgttgaataacacacattttccttcttgaaatattcttagaacaatgttttcattttctccaaggaaaaacttgctcagacacagttctttctgatccaaaccccctgcttgcctctgcctcctctcattgttgtaaaacccaagtgtttctattcctctactctaaacccgctcagagggaattctgccttttgatttggaggtatatttttccatccacatatggcagtatccagtaataatattatacatctaaaggaaggagcaaaattttaatctgtgtgcagctgcatgtatcctgcttctctcctatggcaggattttctagttaaacctctggctagttggaagatgatattagttatagaactagtttgtttagccaaaaaagatataagtggaagcagtactcatgatatagaaatacttaaaactttggagagacaatctgaagacctaactggtgtgttagtcagtaagttttaactccctttaaattgagaatgaatcccagggcccaacattatgagatgctaagtagcttctaaagggattactgtcagacttaaaagtgttttcttttggccagagctttagtggtcttcatataaaatatcagctgctattattattaaactttctatactgaaaaataatgtagtataataatgatattatttcaggcaagatttagttacatgttacaaatactttaaaaagtaggctgggcatggtggctcatacctgtaatcccagcactttggaacactgaagtaggaggatccattcagcccggtagtttgagaacagcttgggcaacatagcaagactccatctcaatcaatcaatcaatcaagaagccggatgtggtggcatgctcctgtagtcccagctacttgggaggcagaggcagaaggatcacttgaagccaggagtttgagtttgcagtgagctatatgattgcaccactgcactctaacctgggggacagaacaagaccctgtctctaaagaaaaaataaaagtagacactattgaatagccaactaagttagagttgaatccatgtaatatcagtctatcccagcatcttatgaggtgggtaaacaccaagtcagtcaacttctatgttataaaaacaaaacaaaacagaggcagaagggagaattcccagcataacgagttggtgggggcattgtaggataggcaggtggttcagcgttcctcctcaaatatccctaactcccacctcaccactaggtccagtgcagggaactcttctacagtatttctgcttacccagcctctccttgcatggtttcccactactggacaagtcagttcatttcttatcttcatggctctaattgttagaaagttgaaattgtgagtcctcaacactccaccttcaataattgctgtccatactcatagccaagacaagctgttattttatgctgtcaagttttagaacacatgcagagctcacataaagcatttaccatggattgttagtgttttagcagagttgaaaggagtcaagtaccaacagtacatgagaaatatcttatccgtctcattaacacctcctttgctttgataaaaagtcctcaagtggtcttgggaacatactacagatgtgcagttcggcatggaaattggaaaactcagatagggcttcgatggaagtcacccattcaaacctgtcttcaacttccattcgactcctcttgttataatgttgatagcaaggaagagagggccatacctaggttcaagtagtgggcatatctgagaagagggctgggggatagctggtcactcagctacagctttttattggccatgctgcatgctcaacttcactcctgaggaaatgggatcaagaacaacacaatatcacttttgctcagcaagccactatatcatataatcacagagctagaaggtcaacccccgtattttacagattgtaaaacagatttaatagcctttgacagaaggtttgtaaacctaaatggctacaggaccaagaaagaaacacaaatgaatgaaatgttccaggcggaaaatctaaatggcccctttttcgttttttgttttgtttgtttgtttgtttgtttgtttgtttgtttgagacagagtctctctctgttgcccaggctggagtgcagtgcagtggcgagatctcggctcactgcaagctccgcctcccgggttcacaccttctcccgcttcagcctcccgagtagctgggactacaggcgcctgccaccatgcccggctaattttttgtatttttagtagagacagggtttcaccatgttagccaggatgctttcgatctgcttatctagtgatctgcctgccttggcctcccaaagtgctgggattacaggcatgagccactgcgcccggtcctaaatggcccttttttcaagaacacaatgaggagtggtgaggactggggcaaatggaggactcgtgccccatctaaaggagtcagctgcttctcaactctaataggttatttttatttttatttattttttattttactttaaattttgggatacatgtgcagaatgtgcaggtttgttacataggtatatatgtgccatggtggtctgctgcacccatcaacctgtcatctaggttttaagccctgcatgcattaggtatttgtcctaatgctctccctccctttgctccccacccactaacaggccctgatgtgtggtgttcctcaataggttcttatgatgaaggaatgcagacccagtgttgccagaaatctggatttttaagtgaaccatcacaaatgactcaatttgaaattttaaagcattatgtggaataacatggtataggccaaccaaaacaagcctgggagtcaaatgccatttgcagatgctggcctggggtcagagaggctcatggaagggttgtgtcctgaataaggcatttgagatgggactatgaatgagtccagatggttttctacaataggcctttgccaatcccttccctcttctccagaaaaaaattgagctatgatttgtgccattctgggaaaaatgactgttgccctctgagatcaaggagcttatcagggtgcagaggaggaagctagctgagaatgggagtgtggagcatggatacaaaagcagcaaggacagagcatgaacacaggaggcacaaagttctagcacatttgaagacacgcctaaactcttgccattagaaccttcaacatttttccccttttcccaaaatcgtccctttgcttactacatattgtcagtaccgccttcaaccaaaagcatagttaatggatttgatatcaacgctctcaagtcttaatacaccgtgttacctgtgacttcgactgacatatcctttccaggggatcagatgggaagggtgcctgacaggaacactggagaatttcagtcctgatttgaaatgaatgatttaagccaactgatgccgaaacgtggtgtgttcagaggacccgctggaggaatgcagcgttgtgcctctccccatttatcatggtgtttacaaatcctgttagaagttgaaagtaaattatcatcctgctcttaatgactgttttttagctaagaattttagaggtgattgagagtgaacccatcactgtagtcatgtgaaggagtggagggaaaggagtgggggaggcacccagggcatgcataatacttgatctaggagaggtgctcatggccaggtctggaaagtcggaagcacctctccttcagatcattcctgtcccagttggatggcttataaaatgtggggtgtttcacattcacattcactgggatttgagttttgatcaggagacaggatcaaagaatcctcagtttcagatatgtgtacaaatatgagtggtgcatcaagtgaggaagacaacgccttcgcttcaaggaactccacgctaatctcctaggcttctcagtcatcatatctgagaatatttatcttagaggagagaagactcagaggggttgtgtctgccttctgatacttgaaaagaccagtatgggaaagcaggattagactccagagggcagaattaggaccagtgggttaaagttaagggaagcagaagtcagtttgacattaggtttgacattagattctttgaaaataaaaaaggcctggggttggacaacactttggtagcagatgttctaaaaaaaacattgcagcatcatacgggggttaggtaagacgaagttcctgttctcatttaaccttgagattctgtaattcgaatctggtttggaatcttgaatggaccaaccctcatgcatttcctgcctcctggatcataaataatgtttttaaaacaatcatctggaaacaaattacataaacaataatctgatttgtacacacatgttcatagcagcattattcacaatagccaaaaggtggaagcaaccaagtgttcattgatagatgaatggataaacaaaatatagtgtatccattcatatgcatacacacacacacacaatgaaatatcattcagccttaaaaaaatgaaattctgactcatgctatcccatggatgaaacttgaggatgttatactaagtgaaataagccagtcacaaaaagacaaatactatctgattccgattatctgaggtacctagagtagtcaaactcattgagagaaaaagtagaatggtggctgtcggggactgggtaagtggggaaagggagagctattgcttaatggtgactttcagttttgcaagatgagaagcatcctgtggatggatagtggtgatgggatgcagcaatatgtttgcacttaacactatgaactgttccccaaaaaatggctcagatagtaaattgcatgtgtattctaccacaatttaaaaatacctaaagaaataacaataattggtctaccaattggacttccctcctgcagaagttaacatggaacagatagtgaagttaaacacataataaaagagatacaaaatgtgagcaaatctcagaagtcaaaattaaatgaatgtgtatttaaaaatcaacctactttgcatttgaaaggtgaagtagcactgtattttaactggatgagtattacccgcacaggctaatggtgcgggtgaagagcctggtgaagagcacaggctccagggccagaatcctgggttcaagtcctggctctgtcttagactagaccttgggaaaattacttaatctttctgtgcctcagtttcattatctgcagaaatagagttatttgtgagacaagtaagagaatgtataaaacatttagaactgagcatggcagatcatagattaataatgctagctgctgttgttgttataaggcagaatgaaaggctgtgtttggagttgacctgatgtattaacttttactcattttttcccctaaagaatttatttaattcacataataaccatgttggtgtttgaatgatatataatgctttaactgaatatttttctgtcccagtgggtgacattatgaaaataatgagactgatgatacattaatacaaagaagtttttgtaatctaaggaaatttacttttgaccacagtcagatatttttcaggcttcaactttgtagacttatgctaagatgtatgactacttcattgcattacagaaatgtaatttaatcatctaagggtttttggtttgttattaaagttttaattctctaaggtatagtgtgaggctaatagtgttttctgagttccaggaattgacctatatttattgtattttttaaccaataattaacacatagaatattaattaaaatatgaaaactaaatttaaggtacctggatagtcctgtaaaatctaaaacttttttaacactaaaatattaactgttagaatgagaatttgaaacttgtaaacacataaggtgtttgtttactgtatattaggtttgaaaattatgtatacatctatctccacattggtatgatttgagctgagcttagaaacaagatgctggcaagcatgaaaagttgaacatcatgaatataagtgtggctgggcgcagtggctcacgcctgtaatcccaacactttgggagtccaaggcaggaggattgcttgaggccaggagtttcaaaccagcttgggcaacacagggagactccatatctaaaaatgaaaattaaaataattagctgggcgtggtggcatgtgcctataggcctagctacttggggaggctgaggtggaaggatcacttgagtccaggtgttcaaggctgcagtgagctatgatcatgccattaaactccagcctggatgacagagggagactgtctctaaaaaaaagtaattaatgttgttaaaaccacaactcttacataagcagttactatattaaagatgtatgcaatgactattcattcctcaaatattttttgattccttgttatgtgatgggctaccctgcttaccaataatacagattgaggacttaattttttaaatctttaaactttttatttgaaaataatttcaaacttaataggaaagttacaagagtaagaacagtacacaaagcactcatttaccttttatccagtttcacctattgcccccatttgctttatcacatagcctatgtactataatattttttgaaccactgaagataagttagagtatggcccttttatgcctcaatatttcaatgcatatttcctaagaacatggatattctcttttatagctacagtataattgtcaactctagtaattttaacattgatgtaatactttattttctgaatttctgttttgttagttgactcaataatgtcctttatagcttattttttccttccagtacaggatccattcccaggcctggtattgtatttagttctcatgtctttttagttgattttttcttgagacgaagtctcactctgttgcccaggctgcaacctctgcctcccaggttcaagtgattctactgcctcagcctcctgagtagctgggataataggcacctgccaccatgcccggctaatttttgtatttttagtagagacggggtttcacagtgttggttaggctggtctcaaactcctgaccttaaatgatccacctgccttagcctctcaaagtgctgggattacaggcatgagccactgtgcccaggcttctttttcatttcttttaatctggaacatgtgccatcctttctttaatgaattgtgatttttgaagaatataatcctccttgttttcaataaaggacaaagaacacttaatttgactttctgacccatattgtgtttgaatgaaaaatgatttactctgctggattctctgtggagccccgtgatcacagtgctgagtccctgtgtcatggtacttcagcttggaatatgaggtttctaaatggaccaatccagtcttgggagagcagcctgctcttaaagagggttattgaccaaatgtcttcacattgtagtgaaatttataaacatacaagcatttgcctaaaaatttctgaaatactgagtaatcccatggtcttttattcaattattttcatagaagtgtgaaagcaagcagtaaaagagctgaggggtgtatccagaagttcagtggaaacatggggatacagacttactatctaatgagaggcgagctactgtttttattgtaagagacagagctgtaatggtttagaggaaaagtggtgaagatttgaattaggggattgtagtagaatgaagtagaggggacggtcacacaaacccagagggctttaagaaacaataggattggccaggcgtggtggctcatgcctctaatcctaacattctgggaggccgaggcgggtggatcacctgaggtcaggagttcgagaccagcctggccaacatggcaaaaccctgtctctactaaaaatacaaaaattacccaggagtggtggcacatgcctgtaatccgacctactcgggaggctgaggcaggagaattacttgaacctggtggaggggagaggcaggagttgcagtgagccaagatgatgccacagcactccagcctgggcaacagaacaggaatctatctcaaaaaaaaaaaaaaaaaaaaaaagaagaaaagaaaaagaaacaataggatttgatcactaattttttgtgagggatgtttgaagctcatcgacttgtggaattgtgaggttgttagtagaaatgggcaatttgggaagacagtctgggacttttttgtttgttctgggaaaaggtgatgattttggtcttggagaggtcttgggctctgctgatgaaggtgtccaacaggcagttggaaatgtagaataaagccaaggagagcatccaaagacatattagagatacgggaattatctacatagagggtgaccattaaagatgagaatgaatgggatccccaagggcgagagcagaagtgcccaggagaggagggctggtaccttggtacttacaggaagaagtaaacctagcacaagtgacaggtggaggactaataagaacacattgtttcagaggccaagggaagaaagttttagacggagggaatggttggcaatgccaacagcaagggagtgtgtggacactgagaagaggcaggcagatttggcaattgaggtggagccgtttggacaaacttgaaagcccgactacaggggattaataaatgtgagtggagaacggtgaggcagaggcggaaagggcagggggctgtgtggcaatgttcagctctagaggcagtgaaaagatgggaacttagggtcaccaggctgaggaacccgatgaccatcttcctgtgtaacgttcagtctttcattgtagtgaggaggcatttctccactctttaatgactcttttaaatcattcaacagtcacttctacccagaagcagatgaaaggatgaaggggcacttttccctgggtcagcagaacagcaccttatcagcaccattatgtgatctgaagggactaggattaaaacccttaagcatcctgccctccagggaaatgtggaaacctgaagcagccccttataacagaaagactctagaaaagtaaagctggtttcagtgggatttctgtggttttctccattgatttttcatttccacctccaagagccttttattgccaagtattaaaaaaaaaaacaaaaaacttcctgtcagtcaagggcagagtctcagcactgcagagagcctcacactgggctaacacctgtcccaggaagttaccgaatgacaagctaaggtgatcatcagactgttccagaaaccctatcaggagctgcagagtcacctggtacattagcccagcaggcccaacatgtcccttcagagaggctggactaacgctgattaagagaaaacacaaacagtacaaagaaggattgctaataggaattattttacacacctttctagttcacaaaccaccacctttgcaccaaagcaaacttgggctattgagccttggaggttatttatttgtatgtgcagggcagtggtttgggtgaagcttgattttctcaccatcattctttctttttccttccaccttagggaacaaacagaccctctgtcacatttttataaagagtagttgtcctggtgttttcaaagttgggttgtgcctcagaaacaaaacagaaattacaaagaagtgtgtgaaatgaatcagtgtgttaacatctgaactaatatggagtaagtgtttatgctgcttgtttcagaactgcatattcagcatgagatacaggtcccagttgcctaaataacatagttccagcgttttctttaggtctgagacagtttgaatgttctttttttttttttttttgagacagagtctcactctgttacccaggctggagtgcaatgacacgatctccggctcactgcaacctccacatcccgggttcaagcaattctcctgcctcagcttcccaagtatctgggattacaggcacctgctaccacgcctggctaatttttatatttttagtagagtcggggtttcaccatgctgggcaggctggtcttgaactccttacctcaggcgatccacccacctcggcctcccaaagtgctgggattgcgcacggctgaatgttcttccattctttatatcccatttagttttgggaaattggacgactagacctagtcgtgctaggggcactcctatgcttgatgtcagaattactcattttcccctaggcactttttctttgtgaatttatctttaaaggacagcctcatcagcatggactcatctggtacaatactagtttgtagaaccatagcacttgtattcactcttaccttcttttcctggaaccaaatcttttacttgaatgtcaataaaatggcccttctcagcaacggaacattcttgactcctgaggcagggaaggaagccaggcacttgtacatttgttttcaaacgaactggttcttatgttgtaaatatttaaccattcaccatagtattcctaccaaagtttccatttgattttcagttaattccatttctcacaagcagataaaggctctttcactttccagaaccctcttttaagcaaatatagattatatttttggctcaagaaggaacaaaaaatggaatttggaaggcatattttttccttggttgaagaaaggaggccacggggaagtaattccaccaagaaagtataatgggtgttatggtaaatcttcatgatggccatgaatatttttattgttccctaccctgtctttgcttaaattgctagagttgtggctaaaagcaaagctgggttttttcttctcaggtttatagctttgagagtcgggagggagggacattaagtgtaaaagctactgaagagggccaggtgatcttatctctttaatgaaaatgactgcagacagcttccttccaacttttgagttatctgggttcctgagtgtccatttctcactggtgtttgctcttaggatgaaactttaggaatgcattaggcaaaagattatgatttacagcataccactgtttactgttttagtaatatatttgttttagggaaaagacctccttataacacatttcatgcttttgatttaagttgtgactcctctttcaagtttgggatattttgcttccaggagatgcattttggtcttttccttttcttttctcttcctttcttccttcttccctataacaggtatctcctgctgcaccaagtctgtgggcaacaatgcaaaaagtcaaccaaaatccaaaagtctaagctgatcccttagtataccagttttaagaatgtctggtgtcacttggactacaaatgacttttaaagtcaaagaccataagcatgagtcaaattggaaacattaccttgtagagccagtctgtctgcctggtcacttaacagtttataaaacttgactcctagctagaaagttaattgccagaggttccaaggaaagcactggactaccactcggaatcctccatttactacataggccaaatgatctggctcttttcaaggagttagcatgaacattctacatttttcttatccaatatgcacaaatatttctttgaagaaagatgacattttaaaggttcttattcaattaaaacttcctaaagcactttttttccccattaactgacaaacatgatacagaactattttctttcaagattattatgcctctaaatctttttctgtctctttcctatttagctttggatttgcacaaaacacccaagcatttttcagcagtgtgagctgagagtgtggaattgaatgaacacgcctgggatttgaaatgagagatctgggcgggggaaggggagaaagatattccttgcatactcatacgccataactgaggattctacattttctttctaaagcatacagtggagatggtttatttctgagagaaattctattttagttttgttttgcttttaaccactatcatgtttgtatttgtcattcttgtacatggattttaaatttaggttattttaatttttctaaccaaatatttttcaaatatccgcttatgttggagagaaaaggacattccaaaagagttacctatagtgtttttaacacataattaaaatgatcataaaaccttcacatgtgctttttatttctcattaaatgccagagggaaaggcaattgcaggcgtgtagtattccgacatttcagcgtgctgcactcctgtccttccgtcgtctggggccacatctgtgatcactgtcttgtgcttgccaatagaggttttcttctggatgctgtgtctgctcttggtcttgtggctttaacaccgaagagctgttgtctacaaaagacagtacattagagctccagagttcactcagctgcctgctttgctcccgtggtgacttcattcttgggaagtttttaggtttcctgggagatgaagcatgagcaacatttgctccagcctgagtaatttcagaaggccttgagtcctgttttgttattcgggtttccaagggtgggtgaggggcatgagaattcccagcagttaccactacacgtgaatactggtatctggcgactctctgttacgtttttaaaaagagtggttatcgtggtgtttttaaagtgggactgtgcctcagaagccaaacagaaattataaagaggtgtctgaaatgaatcaatgtgttaacatctgtactaatatgagtgtatatgttgcatattccagagctgcctcaaattcttttaggatttaataatattgaacattggaaagattgaattaaagccaggtaagacttgctatgtttacaaaattgtttgatgtggtctacaatggattttagtatttttctgagttaaaaagaataatagcatatgcttcataatttttgcctttatgacctattgtttcttcattaacctcagtacaatgatattatattattattggaattgaaaaggttcctgtgtaagccttgcttggtaattcaagtacccttgaattgtataaggagagcgcagatattttaatgccagactcctagtttatgcagtacttttgggctgtagttcccatgttaaatgagatgatcagccaaatctttgctttgccaggaaccaaaatcatttccaaactacaatagcagtatggttacagtttcagcttcatcagccccaaagtaaattctaataggtgctattgaacatagtttaaaatatcctggtgagaaactataggccttaaatattctgttttcaaattttttacctaaccccaaatagctagcttcttagttttatacagctatgccaaaataaaatacaacagaacattcttcttttggggatatgaaacaaatcttttcattttcaacagtgataaccaatcttctgtctccctccctctccctcaacccctcacttccctccctctccttctccctctttagtccctcctcccacccagcctctccctctgtctgtcttttcttgcattacctaaagccctcattgctcacatctcatcaagataaagtcaagatttacacacaatataggaagtgtttctctccagcctcatacctgaccacagcatccttcctttcctacttcacactccaatcgccgagaaccatgtccagttcctgagcataccatactttctgcctcttcctatgtgttacttctctaactagaaggcttatcctcccctctctaaaggctggcaaatattctcatgacatcatgtctttgtctacccctataactaaccatattgtatttaaacttctctcttcctttttagactctaagcaacttgtgagcaaggactgtttccatctcgctcactattatacttagagcctagcacagtgcctggcatacagtagctatacagcacatatttgttgaaggctcaattgagtctagttgtcactcagtttgctttaaacatagagaactctccttaacttttcgtttattgttggagggaagagagcagagggcagaatgtgctctgtggtgttttataactctgcaggaggcagctctttatagcattatatagatttaaaattgaagcacaaaatggttgtgaagaggaagcacgtacgtagggctgcttcatcaggcgaaccctaattcatgtaaaattcaacgctgggaaatcaaaagaaaggaaaatcactctctccaagtggtagaaatgatagtgggattttttttatctctaggtggagatagttttaaaatttgcctccagtctgctacattaattctatttgcctgaatattaattgtgggtatttaaataagacaagttgagtttcacaaatgctgcttgctgctacatttccaccaaaaaggcagcttaaaactgttctttcttaaactattccttcttaaatacatacccattgtctatctcaaacactgcttaccattcatccccaagttgtacaaataagaaaaatttcagataaccatgattgcagttatgaaattgctgggattatgaagcataatcttagtttaacatgcatgggtagaattacctgaagtagctgccatttattcagagtcaatgccaggcattttatttgcatcatctctgatcatctcaacaacactgataggtgggtggtattgtccctctttacagaggaaggaattgaggctcagagaggtgaaacaccttggccaagatcacctagtaagtggcaaatctaggatatgaaacttggtctcttggtccaaaagcttcctttctttatagcatatttctcttcctcaattaaagcactattgttttctcaggcattggatgtttgtacaggtcattttagaatacttttctttgtgtataccatgatgacatcatggctaatgggctaccaacaacagccttcttgaattcacgcccacagacagcattgacagaactttaggattttaatccaaactgttgggagtcttcctatgtccaaatgattaggaattgccaaacagatgagtctacaattgtgtttcccagattctacagccatattacagtatatagatcgtgtgtggctatgtcaaattatttgcttctgttaggatcacagcactttgggggatgcgagtaggggctttttctctgaatattattctcagattttctcccaacttccagactcaggaggttaacacgtgaacttctggagagcagcctgcagggggagatcctagggttcacgtaaagcttacaaaatagcctaaaacttgtgtcccaagtcagacccttcagaactgtggttttatttctggaataacatacaacccaacagccatgtctttagagacttgtggctgaattagttctgatattttaagaaaattaagtttcaggtcttgtagatatgccagtaagatgtccactaggtagagattctacccaatattgtgttctctattgtttatattctgtacatgatggtggtgacaaggatttagggagaatgcctattttaagctctctggaagtcaactgccaagaaagtcagcaacctgtcttcctaaaattatccacaaagcctatgattatcataggtttaaaggcatacatattcctctgttttgcaaaagtctttttttttttttttagaaatggggtcttgctatgttgcccagaatggaaggtagtggctattcataggcatgatcatcatgcactgcagccttgaactcctggtctcaaatgatcctcctgcctcagcctccccagtagctgggactacgggtgtgtgccaccatgtccagcccaaaagtcttactactaacttttattcacgaaggtaattcaaaagatagggcattgattccaacttatagaagctataaatattagccccaagttagttcctataattcaacattggcaacctccccttcgatgagaatgtcctttcaggtgcttcttcttcctttctctatcctggattaccatgtaggccttttgaaaatagacacctactttatgacagtttggacagactaacaggtctgtatgaaaaggcattgaaaatataggcatgatttccccaaaagaaacctagaaatggctttaaaaagttttagaaagtgagatataaaaaaattatagagttaacattgatgttaggaaagtagtccaggaagggatcttagatcttacgttagaatgatatttggctacttctttcactattagcaaattaatttatatagatcactagatttttccctgtttctgaaatccttggttcactggggaaatagccttaaattcaaagagagcaaggtgtatcattatttgtctctgtggttcagtgagcaggttggatctctcatgtgtttcttgatatgaggatgggatcaaccaagaggaaatgtgaacaatgcttagtgaaccttaaacaaattaatgcttttccaggaagtgaatgcagtggggcacagacgttgggattactcctaacctgcagtgatacttgtcctttacttcactcaacaaatacttattgtgtctttgtgccagggataaaacatgccaaaatccctgccttagttgagattatatacagggttaggtatagatagtaaatgttaaacataactattttataaaaagtaatttacatgaatctataactactttataaagaatatttgaagggcatttaaaaattataagtatcaaagtaaagaaataatattcaaagattagtgcatgggaaaaaatggagaagaggatcaggagttctagggtaggaaaaagggtgacaggttgaattttttttttttgatacagggtcccgctttgtcacccagcctggaatgcagtggtgcgatcttgactcaccgcagcttggatctcctgggctcaagcgattctcccgtctcagcctcccgaatagctgggactacaggtgtgtgccaccattacccagctaagttttttctgtattttttatagagatggggttttgccatgttgcccaggctggtctctaactcctgagctcaagggatctgcccaccttggcctccaaaattgctgggattacagatgtgaaccaccacgcccagctggttgtaattttaaataaggaagtgagggtaagcctcaatgccaaagcaacatttgaaggagatgaagatggtagctatggtgacacctagtaaagggaattgtctgtgcaaagactctaaggccaagaccatgcctggtctgtttgaaaaagagcaagaaggccactgtggctggggcagagtgagtgagggaggatagtaccagatcaggtcaaagaggtaacgggtatgtggggaggagtggatcatatggggacttgcagcccgttgtaaggacttgcttttattctggtgaaatgatgaaaggttgcagggttttgagcagagaatcaacatactttggcttatattttagaataatcactctggctatgaagactggaggtgagcagataagggcaaggcaaggattccagtgaggaggctgtggcacggatccaggacagagatgctggtgacttggacctggatcatagcgagggagatgggagatgtggttggattctgtatttattttgaaggtcgaaacaacagtatctactggaatgctcaatgtggggtgagagaaagagagaagtcaagcttttagtgttgagtaccaggtggctggaactgccatcaactgagatggaaaagataagaagtgaaacaggcaagaaaggttttaaacattgtaaattgtgtatagctactaaaattgggtgcagatgttaatgaggcagattggtgtatgaatctggtatttaggagtggaaactgggctggatatgtgaattttggagtcttcagcctatatatgaaccatgaaatttccatgggaagttgctaattcctgaaagtcccgtctcaagaagttgcagccaatgacacaggactcagtctagtcctctggccaagttgatcttgacttttattgtcttttaactacagtagcactgcaccaatcataaccagctacacttgttagtttcattgttttgtatttactggttcaccatattttcataccacgtacagcttgaactaggggtcatctactaaaatcctctcattttacagataaagaggctaggctcagaggagttaaatgacttgcccaaaattacacgaaatggttacagcgggaccaggagtgcctacctttcagctctttcctcttccttacaccagctagagcacttgcagcttcattagatggagcaggaaaggtgataacagagaggtaaagtcagaggtcatttctgccaccaattgtttccttcaaagcaaaactccaggtagtagagctctcttatgcattaactttggtggcacttgcatcctgtacagtaaaaagccacaggcgaagtctagcagacctgccctttgaagggagagtcggagagagccttctgagttgctcaggccaggttttggataaatcagggggtgaccattggattataggaagctgggacatggggaaatcattttttttccattcaatcagtcacaaaaaagtgattcttttcctgttagactaggaaacttaaggaagaaggataagaaagagaatgtaggcgactctgccacgagcttttgatgattcttaatgataaattggagaagcctggaaagagctaaaggaatatagaattgaacatactttttatttgactgtggattacagtcagagatatattccacttgaatttaccccaagtgccagcactttcttagctattgtgaattatgtggatgggctactgagttccaatgggtcattatgtataatttgtaaactgctgttccacttagagagaattaactcattgaacaaatattcatgggttgcaggcatgggaattgtaggatgaataagatagatgaggtatttgttttcatagaatttacagtcttataggggtatgcagacaacaaacaaataagcaaagaaggtaagttcagacagtaataagtgctatgaagaaaatggaacggggtcttgggatagagagagattgagtgaggtgctttaataggagggtcagagaaagacaggtgacttttttttaatctttttttttttttttttttttgagatggagtcttgctctgttgcacccaggctggagtgtagtggtgcaatcttggctcactgaaacctctacctctgggttcaagtaattatcctgcctcagtctcctaagtagctgagattacaggtgcctgccaccacgcccagctaattttttgtatttttttttagtagagatggggtttcaccatattggccaggctggtcttgaactcccaacctcaggtgatccacccgcctcagcctcccaaagtgctgggattacagacatgagccaccacacctggccgcaaggtgacttttgaactgaaacctaaaccataggaaagaaccagccacatggagatgtgggctattccaggcagagagaaaaatcccaagagcaagggccttgatgtgggaacaatcttagcagtatgacagaagcacagcgagcagggttgggaccacatcacgtagggcctcataggccatagtaagaattgtattctaagtatagcacgaggctactggagcattttaagcaaaggaaaaattattatcaactttatttcttgaaatcacactgagattcctttttttgaggaaatagagtcaatgagggaaaaagtcgaagcagagagggagaccagttatgaaattattacaccaatctaaggagatggtggtagcttagggtggtagcagtgaagatagctgaagtgatgaaatttgggactgatcggatcaactgacttgcagatgattgaataaaaggattaagggaagaaacaatggaggagacactgggttttatctgaataattgggatggtaatgggatcatgagtcaagatggggaaaactggagaatagcaagtttgtagagtagaggttgaggggttgggaacagcagaattcagagttctattttagatttattatgttggatagaccaatctgacatccgggcaggtaattgtacaaaagagtttggaatctgagggagagagagagccagagagagaaagttgagaattaccaactttgtataaataatatttaagttcaaaggactggaatccctcatcctaggaaagaatgtagatagagatatgaagaccaagccctgggacatatcaacctcatgaggagatggacccagcaaaggctacttaaaagaaacagtgagttggggacaaggagagaaactcagtagggtgtggaggtgtggaagtcaagaaaagaaagtgtttaaggaggcaatagtgagctgtgatgaatgctgctgaggggtccatgacataaacacaaatcattgacttggcaagaggtggctttgacagagcaattactggggatggaggggaagaaggctgaactgcagtgggttgaagggagaatgggaaatgacaaaatgaagacaagtacagacaatttatgtttggagtttctatcaccattttagctagtgatacggtaatgaggcaggactacaagcagtattggtagaaaaactcccaattattaggctttaaaaaggcgaattaaaactaatacatattcctaggaaatttgatctgctgtgtctacttggggggattaagttttcatggagacaccttgatgagtatccatgttgcctttaccaatcttgaatactaatttcttggatctgtttcctgcagctctacccctcaaatagaacaaaaagcaataataagaaaaacccagtatttatagagcacatagtgtgcagtttaaaggtgtttttgctcattttatcctcacaattcctcaggaggtaggagctgttataatccctttttgataaggtcacacgactattctaaactccaggtgatcaattgacaattgaaatcttgcagccgagcgcggtggctcatgcctgtaatcccagcactttggaaggctgaggcgggggaatctcttgaggccaggagtttgagaccatcctggctaacttggtgagtctctatgtggtggcacacatccgtagtcccagctactcaggaggctgaggcatgagaatcgcttgaatctgggaagtggaggttgcagtggagggacactgcactccagcctgggggacagagtaagactcagtctcaaaaaaaaaaaaaaaaaaaaagaaaaagaaaaaggaaaagaaatcttgttaactggccgggcgtggtggctcacgcctgtaatcccagccaaggcaggcggatcacgaggtcgggagatcgagaccattctgactaacacggtgaaagcccgtctctattaaaaatacaaaaaattagccgggtgtggtggcgggcgcctgtaagtcccagctatgcgggaggctgaggcagcagaatggcgtgaacccgggaggcggagcttgcagtgagccgagattgcgccaccgcactccagcctgggtggcagagcgagactccgtctcaaaaaaaaaaaaaaaaaaaaaagaaaagaaattctgcaacacaccttgtacttgagttgggtggtgcctttgtttcagcaaaaaatcttcattttctctctccttctcacccaaatacccaatagtatgtttaaataatagcattgggattggaacccaggcagtctgggagctccaggcccctagtctcaaccaatatgctatcctttaataccaggcaaatggaagggagactccggaaaggaaaagcagatgacattttatcaaatcagtattggtatagaatgacatagatgttataatgcattgagctagaatggaaaattttatcctggagaacccttcttaatggtgtttttaaatctgtgtgccagtagagcccatactaatggagtgctagtcctcaatattctcccctaacacccattctcactctgctaataaactgtccctcaaaatcaaaatgaaagtgtcacgtatgtacactttccttttggaaagcattttggtatttttctacctgacagctaggaaaacagataattgattgatttgttgcctttattgtttttaagtgcctcttacttcgtgcatagaatttggggcatttcctgaggagtaataagccctcaggaggagaccttatcctccaaggtatagaaagtcctagcagacgttggtggccaggaagtgccctagactggaattatttttgttgttctaatctgaaaatgacaacatagaacacagccaacagcatgcagcattttattatggtgatgcagctttaattggtatgtagagggcatgcctgtgaaattagtccttagtgtattggccaatcagatcactttcaacgtttcccaatgtttagtttcatcttataattaagtaataatgatcatttcctggcagctaatgactagctagaggagttagaagcctcattaggtttataatttatcaaactctaagcttttcatcagtagtgttgcaaaaagagaaagcatcttcaaattccaaaatgattcaaaacaatctctaaccgtatttcatatatgtattcacttgttctttgaagggtgactttatttttaaacttttaaaaataactgtattttattatataagcaggaaaaaatgtttgtgtgacttagaggaagaaggaaagagatgtattgaactctgttagcacatacacacactctaaaagcagaattgatagaccgtgtttcctttaagaatctttttgtgacaattccacaccctttcctgaagctggcttgactatccattaattccagcaatagcatcattgtatttactccacagatatttattgagcacctactgtgtgttgggcattatgctgacgatactgcaggggccagaagagaacggggggagatgggaacaaaacctcctgtctttattaagctgatattatcatcttaaagtttctgtcttcaaaattaccctggaagactgcaattagatatgttcaaagaggccaagctaaaggtagaggaagaccctcactgaaccatgtggacaccttgcctctgactgtctcctcatccatacggccattacatagtagctccagcttctgctaactcaagggtcactcactgatcaaccatatttgggggattacaatcctccttttggtgagagaaagtgtaaatctcttctcctagtttgagacctgccctcctcttcgttttgggacctgacatgagctggtcataaaagaaaaaaccagaaccaaaaaacagtgtcttctaattccaactcgtttccccttgagttcctaatggttggggtatttattaaataagtacagcctgatggagggacagccagacctaccattcaggttgtagaattctagaaatgtggaactcagggactcttccaaagaaattctgtcctgcctaaatcaggtctgaaaggcctctggagaaatggaacaacagcctatgtgtactcactctcttggtctttcattggagtcactcctgggaatccctcaaagatattttctgtccacacactcatgagttccttgaagcagagtaatcttaggtgctcagagaaactccgtagttccttcaccataggagccacttgagatgtgaggtcctctggatcatcagggttggcaaaagcacgcagcagaactccagggaaactgctggcatttggtttgtgctgtcagatcaatcctaggatttcaacatcagaaatacccattattgtcctctctgaaatctgtgggcattagccctggtgcctcatgtaaaagttagccttctggtttccaaaccaattctcttcgtggtagactcttcatgaccaagaattgggacttcccagctctcatgttaccaagtccagttctccaagatggttcctgggaatgcttcttcacgtctgagtaccttgtcctgagcatgtttcataaatgggtaaaatgtgtgattgatgtctcttttattttattgaaagcttgttttcttctgtagcagttctgaaatttcaagatgttcttcattactttgttttaattgccatgtgacaaatatttcaagaaacacccagctattttaaaatttttgacagacttcatgatggaaagacatacacacagccctacttgtttaataaatactccaaccattaggaactctaagggaaagaagttggtaattatttaatgaaccttctgtgtagtcactttcacataaagtatagctaaggactcagaagcagccttttacttcagccctgaaattactactattagtaatttaaaatcacttttcctaatgtgcctagcagtctcatttacctataccacaggtcctcaaataacattgttttgttcaacactgtttcactataaattgatgaggaaaaaaaattgatttccagctggggtcactatctgtgtagaatttgcactttcttcccatgtctgtgtgggttttccccagggactctgttttcccccacatcccagggatatgcatgttagatgagttggcgtgtctacagagtcccagtctgaatgagcatgggtttgtgtgtgagtgcgccctgtaatgggatgacatcctggctagggttggtaaccacctttcaccctgagctgctgagacaggccatggccaaccaaagcactgaactggaagaagtaggtaaataaatatcttacttgtttttattaatctttcttaaatgcatacatagttcacatttatttcaatgattaatattagaagttctttggtcgttatttagaagtttggtgatgtttttgtggccagaaatacatcataggaatttaactcttgtttctatcaattagcctatggtagaattggtttaactagaaatcattttgcttaaagttgtagtttttaagaacctaccaatgacattaactgaggacttactgtaattgtccaagaattatagcctttgaattcattcctggatgagagaaaagatatttctatgatatatactcctatttaagaaatcaggggttttccaaagaaagaaaatatcagtgcttctctgtatgagcccactgtatcaagaaaagatggacccacagaggttgaaccaaaactcttgcagatgcaataggcacaggctctctgtttcccgttgtttttctaggtctaatgaaaatgtgaagactgagggcttggcctcaccctggtaatatgatcaagaacggaactgtggtagtaaaaatgagaatgttagaagaatcattatattcagggaaaagaaaggcctcaaaagggaagattactctgaataattcatgctccttttctcttttttcctgtgtgaaattcagtgtttcctttataattttttgagaagaaggctatgctcaggatctttagaagctggtggtaacttcacaatcactggctccatcaggcaacgagagacttgctgaaggagaaacaaactgtgaaggtaaagaattctacccagaatggcaactctgtgtgctttaagaatgaatccaagttttggaagttgtgggaatgtgttcagtcgaaacttttcaattgcttgcactggggaaaccaccctcatcactaggcctggggattatgaaccaaaaccaaggactccagtctctgagtcagggcgagtgccttgggagggaggatgaagggaactgggctcagtgcctctcctaaaatacctttcccctcctagaggtcaggtctggcagggtttaatgactcaattcgtgtgctgagtggcatcttggtagctccggggaagtagtcaacaccacccaacacaaactgggattggaggttaggtggggtgactatgagctggacacctaagaggttatcttcttggagaggtcaaagaaagcttttgccaaacctgttagatgagtcaacagatagagacttccatctctgctttcgttcatcctaattttttaatagcaccaaatgtgtagaaaatccagaaatgaattatctgatgttgtatatttataacagatgttagatggttggttgattagtgttagctatttccaatgcatgggttgcctctgacataagtattgaattaaatcaaaaatatgtttatatatacctactatgtacccaaaaaaattaaaactaaaagtaaaaatataaaatattttgagtaagcagcatagcaagaccctgtttcaacaaaaaaaaaatcagccagatgtggtggtgcacatctgtagttctagctactcaggaggcgaggcaggaggatcgcttgcgcctaggagttcaaggctgtagtaagctatgatcacactgctgcattatgcctgagtgaaagagtgagacctcatgtctttacaaaaagttttcttttttagtcaaaatattctttcaaaaggatctagttaaaggttaattttctggcatacaaagctagcagaccaaatgggttcaaaactttaaatagcataattcatccaggaagaccattcctttttattttttcctgtgcctttatctgcaaagctctaaaatggccttcaggaataaggcaaggtagctaatatttttcaagcaaattcaagagcaagatagaaatgaaatgatcccatcttatcttttccttcctccgatacctctgcagtctgaccctagggaatgagtgctatgcggatcagatcaagagaggtgatttgtttactacttctgaagaccctaaaacttttgctaaccctaaaagtgacctaacctcttgggaagggaggggcattcagtctcgaatgacacagaccaaccaagaactcctacggaccagtaagcccttaaccgtgtagataccgaagtgagctttggggagagagagaatcgctatcccccagacatggtaaggcagtccccttgaggcagtcacaagtcaactgctcaatctttggctagtgtccctcagtagactagctctagttataaggggatgttctaaataaccccaatggaacaatccacagccacttactgagtacctaataaacccatgtatcactccctgctacctactgttgaggtagatagcctctgaagagcctctggattcacaaaagccaccctgaaatgaatatttctccaaaaagtgcttggggtttcttccacatccccacatcccagctcccttccctttcatgcccacagcaaggtctattgctgcaaattggtggtgaggcaagttggctgggaggtgcacctacacgggggagttctattgtttttataaccagtgccagctctgagtgcgtggtgagtaagagcctcttcctcttccctctgggctgccctcctctcccatgccaatctcattgctggcctgttgtggatatggtggtaagcaagggcggctgcctggctctgatgcttcccagacttgggacccaaaactcaagaagacaacgaaacatgtaagtgagggcttcatgggcctgtgtttcctattagccagtattcctgggtaaagttttctggggagaaggggcaaatgtgaagacaccactacagcgttactcttccttcccccgttaagtaaatgggaagttcttacttggcacacaagaataaaatgaatgttgactgcctcttccagtcacctttgggctgattttaggttagacgacgttttccctaaaggaatcttatttctgcaaacttcttttttaaaactcaaaataatgtctgcttgttcacttttatgttagaaagttataatacgagagtaattatggttactcttgtaaccataattttgcttatacattggttttgctattttcctttctgaatggtgtttattttagattttagctcctctcttgtgttatgttgctaacatttttgtcagctgccagattattacaagcagataaagggggagttttcttctaaagagacccccatagttcacgctcaaagaatttgttttgtataccctgtgagggggtgagggaaataattcattggtgtctttgtgtgtgtgtctacgtgtgtcgttagctgtaatctgcaaagatttctgcatctttaagcataaagatcgctttctcattttgtaacatgatttcttttcaaacttgtcatgtaattgaatccagctttgagtgacactttaaaatatgctctcccgcgtcagaagtgcttctttaagccaggtgctcttcacgctcacctgctggcgtgtttgattagcagccagccacagccaggtgccaaatccattctaaatatgggagcctgtgcttgagaagactagtcatactaattattcagacctcctccttggaagtaatgtggcaaaatcacagaagcagaaaagccagaaacagtatgagacttgctattgagggaccataaaatcagaattttgcctcataatattgttttgttcttgggtacatcctttccagctatgagctcaccagcccttgctctgtctctgagctggttggcatcattgccgttctacagatggagaatgggagatacagctgtgcaagccaaaatgcccaaaagccggatgatctcactgaaactgggagccagcaccccaggtgtctctctagctccttgctgctggtgaatctgcagcttaaaaaaggagagctgcaggctaagttggaaccacctagagttgcctgcaagcaatctgtatttgaattgcctgtcagaggccaggtgaaaccaagcagtgggtcaaaccaaaggggctgcatgcatacataaatgggaagaaggttaaaagtgaggaaatgggggatcgaagtccaggaatgtagggaatatgctggaatatcctttttatgcaggccatccctcttttaactgtgggctgaaatatactggatagtatctgttgtaccgaaagtacaatgtcacactggtaggaaatatttaaagtaaagccaatgtattaatttaaatcattaatgcaggaaatatttattgaggctttcccatgagccaagtcccataatattcagctttgtaacttgagtgcctatcattcagtggatggacaggaaggatgccttgatgaatggataaacacatattgttcatgagattttagtttaaggactctccatcttctccctgctcatcctcccttgggacagcccattcaatcccacagagacacctgtttcacccctcccagaaccacccacccacaggaaggagaatttccttaatgaaggcaagtaaacacaggcctgtatgcccataggaaggaagcctttgtgtacttttacccagattgaatcagggaaaaccatgtcaggaagaagggcacaccctagccgatgcacggaagtaacatttgcatgtcacaggcttcaacccagcaatccaacacacaggtgcgtaatctctgggccaggcaaccagagcaaatttaccttcatggtcttcggagctccaccttccttcattcatcatctcttgagcttgcttctgaaggtcctagcttcatcttggacataagcagccaggatctaggaaaggctcaccaaacaccattatttattgaatgccctcaatgcattggcctcaaaccaaatgcagaattagattactgtccccgaccagttggttcacattttaaacaaataaataggcaggtagaggtgaactaaatagaaaggaagatggaaatatactccagggagaggcaggtgctggggaggggaaaccggtcagagcctgtcatttttagagcttaagtaggacaggatctcaaaatatttcagatccagctccatgtttttgatcagccaggaaggcaaatttggttgagagcaggaaagatgagacacacacttcatgccctcaatgttggctcattctttcctgattgtttctatctttgggcccctattgtgtcttatatgtgcttctgatataggatatggccaatgtactttgttacaaagtaacaaagcaattatttgtttactccctatctcttctaatggatcatgagctcagtgagggcaaggactctttgtcttcctcatttctaaatgtctaaagcctgatcaataaatgcttattgaatatacatatgacaccctcaacccccaaagccatgtaacagggtaaggatgactgcgattgggtctcaaattagaacaagggccaggatttgaggtgttcaaggaattcaaaatagacgtgattggatttgaatggttgacagctttcttgaatatgcagtatgacgccactgggattttgagatgatgggattaagcaggttgggaggaggccagtcactggaggcaaaggctcaggattaggaatgctcttgtggttcttggggaatagtgaatggaccatagtggcaggatgaggccaatgtgtgaagggacaaacaaagttgtttgaaatttaaacttttggcaatgggaaaccactgaagccatttaagccgaactgtaaagagataaaaggaaaattcaaaagaactgaatctaggtaataggttagagcatgaggtgccaggaacaagggctctatgaaggaatggaagccaatacccatgagtgtgtgacaaaatgctgatctgggtgggggaggagggtagtgggaataaatgttaggattctggagtatttgtgggggaggggagatttgagattaatgtatcatttgtatccagagttttctctctaaatgaggttaaaagaatgggccaggagcaatggctcatgcctgtaatcccagcactttgggaggccgaggcgggcagatcacctgaggtagggagttcaagaccagcctgaccaacatgaagaaacccccatctctattagaaatacaaaagtagccggccgtagtggtgcatgcctttaatcccagctactcgggattacagtagctgaggcaggagaattgcttgaacctgggagatggagcttgtggtgagccgaaattgcaccattgtactccatcgtgccattttttgagatgctgtctcaaaaaaaaaaaaaaaaaaagaatgatggctaaactctttattaggtgtttgttaaatgccagtcactgttctaggcattttacaaacagtagctcaattcatcctcagaacacccctttgtagtattattattggccccacttgacagataaactgaggcacagagcaattaaagcacttgcccaaggtcatacagttataagacagagagacaggattcagaccaggatgtaagtctgccaaggcccaaatattaaccacaaatgcctgcttcagcaggttcatgggaagatttaaggtatgatgaaaggggttctaaacagtgatgtttgttatcattttgaaaggagaccagagaagcatttcctgcatccattttcctatcatcgttaattgcctactcacacacagtttaaggttatcagtatatagtaaaatttaaaatctgtaataggataatgtttcttattttgccttttaaacactgatttttctcatttaaaaattagtatttgttataaaaattcaaatcttacagaaataacagatatacagtgaatatcccatgaaatcttaattatcctcctacccccaaatcattatttactgttgggtagaaattcctccagctcttttcttttttttaatctgagacggagttttgctcttgttgcccaggctggagcgtaatggcacgttctcagctcactgcaacctcgatttcctgggttcaagccattctcctgcctcggcctccaaagtagctggtattacaggcatgtgccaccacgcctggctaattttgtatttttagtagagacagggtttcaccatgttggtcaggctggtctcaaactcctgacctcaggtgatctgccctcctcggcctcccaaagtgctgggattataggcatgagccaccacacccagcccacctcttttcttttatatatataggctgctgtattaccatcatttatgtcaatagtaatccttttttccaaaaggtgatcatactgttttgtaacatgctttttctttttcttttttttttttttggcagagtttttgctcttgttgcccaggctggagtgcaatggcatcatctcagcttaccacaacctctctcccggattcaagcaattctcctgcctcagcctcccgagtagctgggataacaggcatgcgccaccatgtctggctaattttttgtatttttagtagagatagggtttctctatgttggtcaggctgttctcgaactcctgacctcaggtgatccgcccacctcggcctaccgtaacaagctttttaatttaataaataggacagctttccatgtcaggacatacggggttttttttttttaacttttatttttaattgaaacataataattacatatatttaagggatacaatgtgatgatttgatacatgtatacattgtgtaataatcaaatcagggtaattagcaaggatatacacttttatattatttcctttaaaagttatataggattcactttcactttcagcatcatttcatctggattcacgttcttttgcaattaccagagcaacatatctgatgtgacctagattcttacctcaatgccatttttgttccttttgtgtcttggacaggacttaaggagaagcaagttcaaatggggttcagttttctgtttctgtgaaaacaagaaaagctagtacttatgtagtacttatgtagcacttatgagccagcaactattcctagctccattgtacagataaggagactgaggcctagagagattaagtaatttacttgctcaaggtcatacagttagaaagtcagaacttgaaccctggctctttgactccaaagcctgtatatttacaccacactgtctctttatctcttttacaagtcttttacctaaactaattaatatgaagtggcttccatagcattatgcagtcaaccatggtgtaaaagtcaataaagataagccctaccacttatctctgtggctcaactagcagcagaaagcagggagttgtctgaaggagcagcttcatttcggctgtttctctctccagcctctccccaccggtcactgttagcctcgagtttgaccctcaacatccccagaggatgcctcctaggactcgaacctcatttagtgtctctactgctgatggacgccatgagtggagctgtcgaccaccttgggtgaagtggtggtctccacgtcccacctgggcagcacgatggccacagaaaggttgtatctaccccacccagcacaacacatgcagaaatttcaaaagagcctatttaagtagatgagcatagatagataattctgggagaacatccttaaaaggagtttggttttttgtttgctttgtgtgggtttttgtctaaataaactagactgctttaatatactgcctcttttaatgaaataaagtaattgtttccttagctgtgtgctaggaaagccaatacaaagacatataagaaaaaccccacagacctagattcttaaaaccattcatatttgatcccattctcaagatatctcattatatacatgcaaatagtccaaaatctggaaaaatcccaaatccaaaacacttcttcttccaagaatttcagataagggttacttagcctgcctcatactccccaaaataggcatcttcatagaacttcagggtgagaaggggaccgaagatttaagaagttccatttcttctctgatacattttccaacagtcccccaaagtgggcaactagcttccatctgaacacagtcaaggaaagtgaactcactaagtaggaaagcagactatttcattttcagaacccgttgagggagggggaagggatagcattaggagatatacctaatgtaaacgatgagttaacgggtgcagcacaccaacatggcacatgtatacatatgtaacaaacctgcatgttgtgcacatgtaccctagaacttaaagtataataaataaatatatatatatatatatatataaaattaaaaaaaagaacctgttgaattgcaacagtgttcttctttatggtaactccatatctgctgtcccaaaacttcaattctttcatccttcttagaccaaacagaaaacatcgaatagtttttatactttaccaccttccaatctttaagaatagtcaccatttccttgccaaattgtttcttttccaggttaaggtctttaattcaatcttcacctattattcccatgtcatgatctagcattttggactgttaaggtccctcttctttgatatgccctaaattgtccatgttgctctcagactgtgacatttatcacataacacggtacttcagggaagactagataaggacagccacttaccttgctcttgatggtctacttctattagatgtgctaagcttaagatttcatccaattctttaaaagcaggggaaattaaggaactttattctggaaagtttgtaaagaaatcaaccagtcatggaatggcaattatgaaaagcacaaaaaataacacatgttggtaagtatgcagagaaaaggcaactcttatacactgttggtgggagcgtaaattagtccagccactgtggaaaatagtatggcaatttctcgaaaaactgaaaatagaactaccctttgagccagcaatcccactactgggtatctatccaaaggaaaagaaatcagtatatcaaagggatacctgcactcacattttgagcgctattcacaatagcaagatatggaatcctaagtgttcatcagcgggcaaaaggataaagaaaatgtatatacacatagtggaatactatttggccataaaaaagaatgaaatcatgtcatttgcagcaacatgggtggaactagaggttcttaacgttaagtgaaataagccaggtagagaaagacaaatatcatcgtatgttttcactcatatgtgggggctaaaaaagttgatcccagggaggtagagagtcgagtgttagatattaaaggctgggaagggtaagtgggtgagtggtggtgatgaagagatgttggttaatgggtacaaacttacagttaaaggaatacgctctaatgttcgacagcagagtggggtgactatagttcaaaacaatgtattgtgtatttcacagtagctagaaaagagacttgaaaaactcccaacacgtagaaatgatgaatactccaggtgatagataccgtaaatactccaacttaatcattacacattctatgcatgtaacaaaatatcacatgtatcccataactatgtacatatattatgtattaataaaaataaatagaaatcaactggtcaatttatttttcttcaaacaataatacaggaagccaggcagagtggatcatacctgtaatcccagcactttgagaggccaaggcaggcagatcgcttgagcccaggaattcaagaccagcctgggcaacatggtgaaaccccatctctacagaaaaatacaaaaattagctggatgtggtgatgtgcacctgtagtcctagctacttggaaggctgaggtgggaggattgcttgagccctggaggttgagtctgtggtgagcagtgatcatgtacaagctgcaccccagcctgggagacacagctagactctgtctcaaataataataataatacagaaaaaaactatggacctagatattttattttatgtatcgtagtatctttcttacatatcagtttttataataatatttatccatgataccatctgtaagacaggaattgtgtaaaaataacaatgctggctatgcacagtgactcatacctgtggtcccagcactttgggaggctaagacaggaggctcacttgagaccaggagttcaagaccaccctgagcaacatagtgagaccctgtctctgcaaaaaattaaaaaattacccaggcatggtggtgcgtacctgtggtcccagccactaaggaggctgggatgggaggattgcttgagtccaggaagctgaggctgcaatgaactatgagtgcaccactgcactctagccttggtgacagagtgatatcttatctttaaaaaaagaaagaaagaaaaacaaaaaaccaatgcttaacttttcataagtgtctgagtaacaatccctgtggtaccaaatattgtggcctgttgaaagtaagagatgaactattgtagagtatttctttatgccagtgattctttgaaatggatggctaggctgttaaagacctgcatttttttttttagcagcctcctcctcggcccaccctttactgccatcttgatggagtcatgtttatatgaatttgttcagatcgctttgaaagagctcactacttccctcctccactgaggatttaggtacccactccagatccagattcggttttgtatcactagaaaaaatgtaatagagtagatctatctgaaaaggctttctttgattagaaactgtgaccatgtagatgtaagatttgattataactttagacttaactggagaagttattgctagaatatacaaggcaacatgtggtggtggatatatgaaggtggaaaaatacattagatgtccttatatcattttctaaaaagcatatgatggggggagctgtataggagagtatcacagaaaattatcacatataggaaactatcgtcaaaattaacagtgtccctcagccattgattaaataaaaaaaggaggacaaaattttttaagacaaatgaactttaaataaaggccactaattatagcagagaatgtgttggataagagtaggtatatgtaattatatagtaattatgctgaaaatgtaatcacatgccaccggctagctagttaaccattttgctgggggatgaatccacccccagcaaccatctccttctgatctcagagacccacattgactttgttagaatgtgtgatatggtttcttcttagaagggtgaccttttcctggccaattaaaaggtgctgctttgaggatattggaacccatactcaaagggataaaaggaaattgaaacttctattaaaaggagctaatgatgcctggagcagtggggattaaaaaagaacaaagtcagtcttaaaaagatcccccaaatcaaagagctgcttctctcatcaaataccagaagaaagcaaaatgatttttaatgaaaagtggggcaatggattcagccttttccctggatcctagggcttcaatcaaaaccagtgagtagttttaagcaaaattctttgaacatttgggataattatgctacataaatttgacatggtgttgtaaaaggtaaactagcttttcttccaaattagagaaataataaagacaaatatcagaaggataactctaaaaaatcatacagataagagtgctttataactgattccccatctgatacaaaataattcctgggttaaaatctagcattttgatgataaaagtataggaaatcactgtcaaaattgtcctgtggtggacaattgttaggtgattgctgtgattgtaattagcacaaccttggtaggttgtacattccttaatacactttcttatcaccatctgcattagtctacttgggcagccataacaaaataccacagaccatgtggcttaagcaacagaaatgtatttttgacagctctggtggctgtaaagtccaagatcaaggtgcttgcagaattcaatttctggtgagggcattcttcctggctcgcaggtggcttccttctccttatgtccttacatagcttttcctaggtggatgtgcttggagagagtttaaaaatgagctctccaatgtctctacttataatgatattaatcctatctgatcagggccctacctttaagaccttatctccaaatacggccacagtgaaagttagggcttcaacatgagaatttggggagtacataaacatttagtccagcaactcaaaactacaatgagatatctcacccaagttaaaatggctcatattcaaaagacaggcaatgacaaatgctggtgagagtgtagagaaaagggaaccctcatacactgttaatgggaatgtaaattagcacaaccactatggagaacagtttggagctttctcaacaaactaaaaagagatctactatacaatctagcaatcccactgcagggtatatacctcaaagagaggaaatcagtgtatcaaagaggtatctgcacttctgtgtttgttgcaacattcttttttttaagtatatttatttatttatttatttatttatttatttatttatttatttgatggagtcttgctctgtcacccaggctggagtgcagcggtacgatctcagctcactgcaacctctgctgcccgggttcaagcgattctcctgcctcagcctcccaagtagctgggattacaggcgtatgccaccacgcccagctaatttttgtgtttttagtagagatggggtttcagcaacttggccaggctgatcttgaactcctgacctcgtgatccacccatctcagtctcccaaagtgctgggattataggcatgagccactgcgctggcctcaatattctttacaatagctaagatttggaagcaacttaaatgtccatcaacagatgaatggataaagaaaatgtggtacttatacacaatggagtactatttagccatgaaaaagaatagaaccagtcatttgcaacaacatggatggaactggagatcactatgttaagaaataagccaggcacagaaagacaaacattgcatgttctcacttatttgtgggatttaaaaatcgaaacaattgagctcataaacatagagagtagaaggatgttaccataggctgggaagggtagtggtgggctgggtggggaggtaaggatggttaatgggtaaaaacaaaatggaaagaataaataagacctactatttgaaagcacaacagggtgactatagtcaataataacttaatcgtgtattttaaaatcacctaaagagtgtaattggattatttgtaattcaaaggaaagatgcttgagggggatggataccccattctccatgatgtagttatttcacattgcatgtctgtattaacacatctcatgtaacccataaatatatatatatatatatatatatatatatatatatatatatatacctactatgtacccacaaaaaatgaaagtaaaagtatgatttttaaaaaaccacttagtccataccaccatccaacaataagcaagaagccagggaatctctgggcttgtcaagtagctgggtttcctgccacacttggatatcaatggctaatgtctttaccacttaaagaatagttgggagagtggctggcaagcagtcaggaaacctaaaagccagctagtgctgcattttctatttgtttaaattataaatgaattaattgtccaagccaaagagcataaccagtagaagcctcctccttacaaatttgcttgaactcccaaaagatatgtttaatggcaatgtaaccaatcgggaaattctttgtcataaaccatcagttttgaatatgagtcatctatacagcaaatcggggtattggcaaaggaagcttcacaatgtccagctttactgcccctgcacttcagcctgccatggttttaatggtggctaaaatcattattttacaattgaaaatcttttctagaaagctggtcattcctatttatacttggactcaaagctacctaaggggcccaggatgcctcatctcagcttggaaattctagaattaattatgtgttctaggatgaattaagtgttcaattcaattccaaaaaaggacacaaccatttctgtgctcatatgtattaggctgaggcaaacttacctggtgttggcagttggttttggcagtttaataatttgagctagataaagaaaaaggaggttgttgagacaagaaagatggctcttctcaaaagtaaaagacatctggactgataagaaggcaactgagagagaagctaaagataaccaagagaaactgatcataaatttgcctcaaggttcagacagggggtcatgcagttgaattataggcaggggtcatggtggcggctttagaacttgtgtcctgattctgatgtctctaggcagcctctgtcatgcacccatctccaaacattgggaggttgaatatgcatgtatgaaaagaattgcccagtataaacatgtattataggttacacatagctgatgggactatgaagtccctgagaagtagctcagcctgtgtcccatatcacaggctcctgccttaactgtgctatgtcgaatggccaataaaactcatgcaacagcataaaagttttaatttttacatttccttatgatcccagggagaccaggccttcctggagagggtattccaggttatgagttcatgcaaagtaagagatgtaagagatacacttgagtctccctctctctctctctctctgtgatgtatgtgtgtggtgtgtataagtgtgtgtgtgtatatatatacatatacacacacatatataaaacatataatatataactcaaaaaatattagctggtgagctaatatatgtttaccctcacgatccaggcattctacttggttgttgagggatgtagacctggagcagatatatcatggtgtggtgagacaagagatgggaggagagggccatgcatcatattccattgatcctcagtaggacttttgctatatttacagtctaacttcaaagctagaactgatctcccttaagtctgaggctatgaaatgagctcatattatgaagaattgctcagtaaacttaaagaagtataccatacaattatatggtttatatcaagtatgatgatcatttctgccacttgtaccactaagcggtcagggttaggaatcctatattgaattcttccatgtgccagaccttgttctagatcaggatttttcagccttggtgctgttactgtttggggttggatagttctttgttgttgggtctgccctggccattgaaggatgcttagtagcatccctggcctttacccaataaatggtagaagcatagcaccttcccccaattgtgacaacccaggtgtctccagacattgcaggatgtcctctgggagcaaaattgcccctggttgagaaccagcattctagatacatgacatatggtatgacatgtggtatatgcaaaaagcatgaactgcagagtcacattcttgtcttcatttcttcattcattttatttaactaattaatttttttgagacagagtctcactttgtcactcaggctggagtacagtggcaccatctcagctcactgcaacctccgcctcctgggctcgaaggatcctcccacctcagccttctgagtagctgggactacagggccatgccaccacacctggctaatttttgtattttcagtagggacgaggtttttccatgttgcacaggctggtctcagactcccagactcaagtgatctgcccacctcagcttcccaaagtgctgggcctatggcttagctgagccaccatgctcagctcgttcattttatttattgagcctttgcaacatgccatgaactgtgctaggttatggggatacaaagatgagtaaggcatggtttttgccttaaatagaagactctagtaatggagaaaaactcatatatagataaattaccaatcaatgtggtaaatgtaacaaaatagacatgataacaggcttgggtagagagttcctaacccagctgggcagtagaagctggaggcgtcaagaaaagctttctcgagttgtctggcctgaactgagtcttagataagtgggtagaggaggtgaggacactgaagcagaggcataattcagtgttgcagttaacgtcgaagtgtaagataagacacaggtgaaaaagcctggtgtgtgttgagtgttgggaagggaacgttaaaagtctgccgaggtagacaggtgaccttgtctggcattctgagagtttgtactttattctaagaggtggggagccattgagagccttcaagtaaggaagtgacatgtttttgtttaaaccagttgttttggcaacctctactggctggactcaagggatcctcccacctcagcctcccaagtagctgggactacaggtgtgtgccaacatgcccagctaatttttgtattttttttgtagagatggggtttcaccatgttgcccaggctgccatgcagaaaatggattaaaggagcacaagagtgaaagcagggagacaatttagatttgccaagaggtgatgagggcttgacctagggcaatgggaaataggggacaggatttgggaaatattttggagataaaacagtatgatttagtgactcttttgatacaggagatgaggaggagggggagggttcaaggatgattgcctctcacagttggggtgccaccatcattgcctatcctataggaaatatatagtgatggtaattattgtattatgctattatattaacttattatcctcagtttgcaaatgataaaattaaggctcaaaggagaaagttgcttagcccaaagtcacacagctattgagtagagaagccaggatttgagatctatttgactatctgacttccagcctatcatactatgtggctctggctaagtatggattaaagtggtgaaaatgaatcattcagaaagtagtcagcttggttactgctggcctttatgcttggccagtgctcagtatttgttgaagaaaggaatgattttaatgaaaattatactaatatatttacatatcattttcatgtatttcaaattagaatgcatgaggggaaaaataaatagcttatccaatattatatgcaaatatcccccacctgagctgcagctttagtctcttctcaggttcctgcagctacaagtgaagtcctgaggtcccctagtccattgttctgcctctttgtttaatcactcaccatgttctctttagacacagtgctaaggacacaggtatagcaaatacttgttaaatgattcagtcatttatacatttttagcatcaccattacattctgggccaataagaggaccttcagtcctattgtcatttctatccaaaaatattaaatgtgaccacgaccaagaaagactgttgggcaggaaaaaagggaaaaatgtcactgggctaaaagtggaaagttatggatattgttaagataaacacaaagaaattcctgtgttcttttctctagggttgctcacttaacctttccgtctccaagtccagacttcaaagctccaagaaaaaacaagatacaacactgtaggattagctgcccaatttacttatattttaagaaagtgtccaaaaaggccagttaagcctgtctgacagcagtgacaggtctcatcgtcagaaatttcaagaatgattatagcctgtgacctgtgatggctccaaaggccataggaattgccaggggatgtcactggcatttatctctcaggatcaccttccttctctctgctgggggagtcagttctggacctggatggaaaaggattcccagtacccagttacatagctgcttacatctgttatctgtgcatgtgaggttttatactagaccggaaaatagagagacagtcacagttttgtattcatgaaattagagactcgtggagaccattctgctgtggcctgttcttaccctgctgtatcagagattccttggtctggagtcagggactcaggcatggtgagggcgccaggagagctggcagggagttcctcatttcttattcctgctgctcctgcttcatttccaactataaggaaactcatggaagtatttttagtgtatttgtggtaccagagcccctcaccattcccaagacaaggcttgactttccatcccatagtataagcagagtcttgtactacggttcctcttaggaattactgctgggcagtaggttattaatagtaacagttcacacccagtccaatttaaaagaaacagattgttcctttaaaaaatcttctctgaatttaaattacaggtatttataatatttctccacttcttacctagacactggatattcctccaggttaaatgcccttggactatatttttctttgcctgctggattttattcactctttatatctcagtgtcataggccctttctaaccctcactgagttgcatggcacctggaaaaagcccttcttactcgactgtaatataattgtccatgaaagacctcaacatttctttgggagcagagatggtttgcatttattgtagtatctccaataaggcacatgcagtgggatgtcaaagaaggcttgaactgaataggagcacatcctaacttgcaggccagtagacgtggatctgtaccaatgtctgtctcttaccagctgcataatggaaacattacttactcttgctgaacccacatgaaaaatggaaataatcatcttaccttcaagagttgtgaaaaatcaaacaagttcctggcagaaagtaggtgctgaataaatacacatattcaccaggcacagttgctcatgcctgtaatcccagcactttgggaggctgaggtgggtggatcacctgaggtcaggagttcgagaccagcctggccgacatagtgaaaccaccatctctactactaaaaatacaaaaaattagatgggcgtggtggcaggtgcctgtaatcccagctactcagagggctgaggcaggagaattgcttgaacccaagagatgaaggttgcagtgagccgagatcatgccattgaactccagcctgggcaacaagagcgaaactctctctctctctctctctcgctctctctctctctatatatatatatacacatattcatttgatcattatactaggttgaggatttaagttctttccaaaacatttatgtaaggccgttgatagatggtgagaagtcttaatctaagtatcaacgtattttctaaaataattttgaacattgtgagaggcagagtgaaagaaacacagtatttgaagtcaaaagacttggtttgattcattttgtgacttttcctcctggtaaatgacatatacactcatttatagccattcatgatgttcaaagctatttgccttaacttgtccctgaatatgcctgctcattactagcgctaacatttttaaatggaatatctgttactcatttataattgctttcttttggttcaaagtgtgctctgctctcctaatgttcccaaatagtgagggtgctgctgtttgggggtgggggggtccccttggagtttagattctgtttctgtggtgcaacagtgacatccattgacctgttatgctaattatagaagaaacctgcttctctgctctgtgactgttggattttctgatataaagatacaaagagaacaaactgtctccgggcccaagtaagacaagctagtggtcaacacctggtcccctgcagactgggctggtttcaggacccttcccaaggatacatattctaagatcagtgccagctgggtgttcccttctggtcaagtggagacagtcctagaactggtcctctccatggagttcagcacgttcattgggctgttgggaaaccattggtttgggctccagcataagccagggcaaatcactttgcctctggacttttccacattgataaaatgaagtcgatagcaatacctgctttgtagttaccaaagtgctcttccatgcattttataataacttcccacaatcccacaacaattgtgaaaattaggaaagcacagatcagatctgcttagcatccaccgactgtgaggatgtgaagctgaacaccaaattacagggtttcaaacctcaagccttggtgacttatgtttgctaccttagttggaattaatgaaatcattacagaaattcctgcttcatttctggaagagccctcaggggaggttctaaaaatggaaaatcaaaggaaaggctatgtggctggatgtgagagattgagcaatgagtcagtatctttaagtagaaaaagatttacattgctggtttccatctccataaagaacataacaggaaatagcaagactaaaaatatttatttttgcctagtatgtgtcagatactctgttaagcattaagaatggaggataaactagacaaactgtttcataccatccagaacctcactgtcaagtgagcaatacagagcaggaacagtgaactatatataatagtgtggtaaatgttacatcaagcattcctgcaggatgctacccttccaaaccccctcccatgtgtgtatgtgtgtgtgtgtttgtgtgtgtgtgcacatgcccgcatgtgtgcttggtaggatccaactagtaactaacataggtacctttggatggataaacagatgaatagtgtcaattcaactggaagccaaaacatcaaacatttttcaatatcaaaaccaagcagattgcaaaactgacacatcagatacataccacacacaaaaacaaaacccaaggattcaattgcactttgtgtcatttcatagtaaatctttttttggaaacaattagggaatgtgtaactaatttgtggtggacttagcgaaacccaccactgactcactggtaaagccttttcaaaacactgttatgattaaacaaaccaaaaaaaaaaaggctcatctaaaaatggacctcattcagatcccattcttccttctcggttggtcctctagcatgaaaagcttggttctggtgtcccctctgattaaattgtctcattggaaccctcattgtgaatactcaaggcccatccttcagccacctctcctctccctcaaagcacttcccgatgtgaactgactcttcctcactagagagcctcaagtggatggatcactccctacttacaggtggaactttctgaggacagaagccaacagcagaccccaggcaccttgccaagaggccaggccccatgactgagttctttactcccccaccatctagccatctgggctcctttggaaaaagtacagcccatagtttaaaacattacttttcatattggtcatttgggtttagagccatatgttagacaaactgagattttagcctacagttgttggctctctttgcaattcttatgtatatgtaacaagcaccaaagtatatatcagaaatccagtgaagttgctgtgggctttcagaagcatttatttatttatttatgagctagagtctcactctgttgcccaggctgaagtgctgtggcatgaccttggctcactgcaacctccgcctcccaggttcaagcgattctcctgcctcagtctccaaagtagctgggactacaggtgtgcgccaccacacccagctaatttttgtatttttagtagagatggggttttgccatgttggccaagctggtcttgaactcctgacatcaggtgatccacccttcttggcctcccaaagtgctgggattacaggcgtgagccaccgcacccagcctgagaaaacttttttacaaaacaagaaaagatgggttcattttgactgaagcaacccatctaaaacatgcatatgctgaataaaccaagaatgaagctgcgcaggggtattcccagaggctgtgctcagatgctgggtatcacacggaggccaccagactcgagagtgtgaagctcactgcccctccccacctcacacgcacctctctcacccacgtcagggcactgccacccgcctctgtgcaccccagccccctccagagctcttcttgcttgggaagctccagcaccatcagcatcttcaccattcatcttttagcaatttgcacttgggcatagaataaacccacaaggagccctttgcaggactatctgattaagtgcatagagtgatttgaggtcctctctagaggtctcactgcccaaaaatctttcacccagctgcttagggtcccatatccctctatgaggggctcattcatttgagttaactcttaccctgtctgtttttaaatagctacccctaggagagagtcatcaacacctcagcgataactagtctatcacatattggttgcattattttttatatttattttaattaattttttttaagatggagtcttgctctgttgcctgggctagagtgcagtggagcaatctcggctcactgcaacctccgcctcccagattcaaatgattcgtctgcctcagcctcctgagtagctgggattacaggcacctgccactacacccagctaatttttgtatttttagtagagacggggtttcaccatgttggtcaggctggtctcaaactcctgacctcaggtaatccacctgcctcagcctcccaaagtgctgggattatagacatgagccactgtgcctggcctgatgaatcattttttttcatttgtgggtggttattttgttttttgagacacagtctcactctgtcacccaggctgaagtgcaggagcacaatcatagctcactgcagccctgaactggtctcaagtaatcctcccaccctagcttcctgagtaaatgggactaccggcatgtaccaccatgccggcttaattttttatgttttgtaaagacagtgtctcactgttacccaagcttgtcttgaactcctggcctcaagtgatcctcctgcctcagcctcccaaagtgctaggattacaggtgtgagccactgtacctggcttaatttgtttttaaagatatttttattgagagataatttatataaaatgtgtgactcttgagtattccagttccatgaatcctgacaaatgtattcacttgtgtaatccacatccctatcaaactataatccattttcttttttttttttctgagacggagtctcgctctgtcgcccaggctggagtgcaatggcgcgatctcggctcacacaagctccacctcctgggttcacgccattctcctgcctcagcctaccaagtagctgggaatacaagcgcccgccaccacgcctggctaatttttttgtatttttagtagagacggggtttcaccacgttagccaggatggtctcgatctcctgacctcatgatccgcccacctcggcctcccaaagcgctgggtgggattacaggcgtgagacactgcgcctggcaaatatagtccatttttatcaccagataaagtttctttgtgcccctttccagtccgctctgcacctccaggcacctactgttctgatttatttcaccatagattagttttttctatcctagaaattcgttaaatgaaataacacagtatataatcttttttgttgatatttgtcactcaatgtaaggtttctgaactttatctgtgttgttgcttgtattaatagttcattgtttatccattctcctactgatggacatttggattgtgtctagtttggggctattatgaataaagctgctacagatattactgtacaagtatttttgtagacatgtgttttcatttttcttgggtaaatacctaagagtaaaatgctacctcataaggtggatgtgtgttcgattttccatacccttttccaaagtgtggtaccattttgttccataaccttcccaacatgtggtactggcagttgtgttagttttctattgctgcataagaaactattacaaatgaagtgtcttgaagcagcacttatttattagctcacaatactctaggtcacggctgtgcatggcatcattgggttctctacctaagacctcacaaagctgaaatcaaggtgtagactgagctgggctcttatctggaggctctaggggattctacttcgaagttccttcttgttgttggttgaattcagctccttcttgttgttgtttgaattcagtttcttgtggttgtaggatgaagtccccatttccttaatggctctcacccagagctgctctctctgctcccagaggcagcctgcatttcttctcacatggaaccccacacacccatcttcaagcctgcaagacgcattgaatccccctcgtgctttgaatctctctgccttcctcttctactgccaggcagagaataaaaactctgctttttaaaagactcacctgcctgggccaaacctacctggataatctcctgtatcttaagattcattgacttgggacttcaattgcatctgcaatttcccttcacaatcgatgtttgaataactaggggacaggaatcttgggacatcttcagaattctgcctaccatagcagtccatgatgaagtcctaaaatcaggatcacttttcattatccagttgcttaagaatccacgtatactttccttctaaagaagcatgcctactgtaggttcaataattgcaatcctgtggttcgagctacttgagaggctgaggcaggaagattgcttgagcctaggagttcgaggctgcagtaggctgtgattgcgacagtgtgctccagcctgggcaacaaagcaagaccctatctgagggagagggagagagagaggtagagggagagggagaggaagggagagggagagggagggagagagggagagagggagagagagagattcacagagttggttactgagagccatgtctctagattcctagcctagaacattgtctactacactctaatcacttcttgcttctagacagagtctgatcctataaggggactttgcggtttggtaatttaaatcaccataaaagtctctggaaatctagaaaacatttattgaaaatcatgcatagatagttccaaatcaaaatttttaaactggctaaatctattccaagaaaagttatactttgtcagcttgaaaccaactgggtagggaaggagccattgggtctggcatgttcatgcctaggtgttaagatcttaggatttctcggttgtgtgtttgaaatctcactcaacccggggaccctgcatatctccctaatagagaataagtaatcataggcctggcattcaagatactctcataagccttttatttttcaagatagattccagagaagttggttgtgaagctacacaacttgctaagtcaaggctagaatccaggtctccctgttgctatacaccagaggtaataaccagcagcaaagaagcccaatctctcgtgaagctgtgctttgtttggcccatagattgttgttgttcttgttgatttagagatggagcctcactatgttgctcaggctgaactcctgggctaaagtgatcctcctccctcagcctcctgggtagctgggattataggtgcacactgctgcgcacagctttggtttttaattggattaatttccaatatttaaaacttggaaaactttacataaacatccagatgtccaggatttttctgaaaagttgggaactcaggtaacagtggacccactttctgcagtgtaacagttgggttagagtggtcctttaaacaggacatgaggccttcagtggccatagttccaactggttcactttccccatttaccctcttggtctctgtaggaacttgagtcatgacacctgcctcaccccaagctgcagttctgagataccttgtctgactattcaaacaatttcttatctggcctatatataccaagtatgtttggctctcatttcctggcagttgaaaataataaaccagattttcaaagtgggtgaactacttgctggctgtaagtctggcgtcattgaaagaatactttctctgtaggcccatagtcatttaccacatgggatcctcctggctgtcagcattcatgtaatttcaaaaagtatccctttccttatgtgctagcttactcctcagaaagttctgactttcagtgaataaaacatctgatatttgtgaagtcaaagagtttgcctagaaaagccactttctcatctaaagagcttactgaacctaacttctttggagaacatctgtgtagccatatgaaattaatgcaggcagttgttaattgatcattcttcttgagtttatgcagccagaatctttcattgattaatagttgtgattctcaatcttagctgcacatgacaatgatcttgacagcttttaaaaataatgatgcctgtgctacaattaaaatagtcgtgatgatgatgatgcctgccattcatccccagaaattctgattcagttggtttgaggttggtcctgggcctctgggtctttatgcttttgttactgttgtatcgttttattgtggcaaacagacacacacatactcacatacattaaatttgtcatcttaaccagttttaagtgtataggtcaataatgttaagtgtatagttcaataagtttaagtatatcaaagttattgtgcaatggagcttgataacttttttatcctgcaaaactgaaactctatacacactaaaaactccatttccctcttccacagcctctggttgcgccttggttttaaaggcttccaggtggtcgagcacggtggcttttgcctgtaatcctagcactttggtaggccgaggtgggcagatcacttgagcccaggagtttgagaccagcctgggcaacacagtgagaccacgtctcaaaaatatatatattaacaaaataaaggcttccaggtgattcagatgtgcctccaaccttgacttggagggaaggattcccacctcaaaggggttctaaggattttacagttcttaccagggtttccacagctgccaataccatctacaaataggtaggatgggttttttgtgtacacagtagtactaggacttctgatgaacttgagtacagttagcctctgcttcaggcctccaactgtggaaccacctccacttggctgcagctttacctatgaagtactcattcatgccatgtggcctggctgggatccatggggtttttttaatctcctatctctctgccatttatagcttgtgtttgatttcttgacccacccttaataccagttgagggtggggcacctgggaaggtgtaccaggaagctgtggcattccaagagttctttggacttggactgtcagaagaaccagtcatctggaagagagcccagatccatatggacttcctgcaccagcagtggtgaaattcaaggctttgcctggagtcctggactgttctatggatttggctgctttttgtcacatctacaataattaaaatggtgttttgtgatgtttgtggctgtttaagcttacctattttattaacttgattcctggcactttcatctgtctctcatgatcccaatagaatagaaacattgccctgttctggtattttccatgagctacctgttgtgttcatctgtggaaaacagttgttttgagaaacagattcaagttgatggagctaggacctggcttgcatcctttttttgtagcataaaattcaaaacctctctctcctgtttactggtatatgtctaatctttctctctgccatcaggcgtgacatcctgaccccacgccataccttcattccctgataagcgctgccctggtaagttccactgcatcagtgctgacctacctgacctggcatactacagaaatctttaagtgcattaggacgttccagctgaacacttttatcacaaaagcaaacaagactgggtcacccttaggacccctatggattactgggaaaaaaagaaaattttatgaggaaaatctggggttaaagtgttgttgacttacggtggtacctctaaaatcctttaaaaaagagtaattttctgcattgtcggtctagggtttaagaaaagtccagtgataccccagtgtcaaagctgcagaaagttctggcctcactcattgcagctggagctttgcagttttaatcttggacttgttcatgtgattacttctattcagatacatcagtggattacagcctgcctggtgtaatcacggctcactgcagcctctacctccaggtctcaaatgatcctcccacctcagtcccctgagtaggtgggactgcaggcatacaccattatgcccaaccaatttttaaattattttttgtagaaacaaagtctcactctgttgccttagctaatctaatcttgaactggtgggctcaaatgatcctccctcctcagcctctcaaagtgctgggattacaggcataagcgatcatgcccggcctgttatgtagtctttataacatttttttaaaaagaggaaatgctaagcaaatagatgttattaaaattgtagtgcaaaccaaaacgagaatgtgggaagatgttataagatgtatgataaagatctttcaattcttatatcttaatttcttaaaaggaaatacagagcaagcagggactcagagctatctgcatacccatgttcatagcagcatcattgatgatagacaaagggtagaggcaacccaagtgtccatggagggaagaataaataaacaaactgtggtataaacatttaatggcctatcattctgccttaaaaaggaatgaaatcctgttacagaatatgacataggtgaactttgggaatgttatgctaagtgaaagaagccagtcacagaaggaaaaatacagtgtaattccacttatacaagttacctagaatagtcaaattcatagaaacagaaagtagaatggtggttggcaggggctggggaatgggaggattggacaattattgttcagtgtgtacaaagtttcagttttacaacttcgtaaaactgaagagtaaaagagttctgagtacaagagtaaaagagttctgagtacaagagtaaaagagttctgtagatgaatgctggtgatggttgcacaacagcatgaatatacttaatgcccctggactgtacacttacatgtggttaagatggttcactttacattatgtaggctgttttttcttttgttttgtttcgttttttttagacaggttctcgctctgtcacccatgctggatgcagtgatgtgatcacggcttactgcagcctcaatctccagggctcaggcgatcctcccacctcagccctgagtagctgggactacaggcatgtgccatcatacccagataatttttaaattattttttgtagaaacaaggtctcactctgttgctggtcttcaactcatgggctcaagcaatccttcctcctcagcctcccaaagtactgggattacaggcatgagccatcatgcccagcctgttatgtattctttacaacaatttgtttaaaggggaaatgctaagcaaatagaagatgttattaaaattgttgcttgggcgcggtggctcacgcctgtaatcccagcactttgggaggctgaggcgggcggatcatgaggtcaggagatcgagaccttcctggccaacacgctgaaaccccgcctctactaaaatacaaaaaaattagctgggcgtggtggcgcccgcctgtagtcctagctactcgggaggctgaagcaggggaatcacttgaacccgggaggcggaggttgcagtgagccaaggtgcgccactgcactccagcctgggcgacagaaggagactccctctcaaaaaaaaaaaaaaaaaaaaaaaaaagttgttctgcaggtgcacgcagggtgcggggagggagcacataatgtcacgccccctctcccttgtccaccgctgcagcctcctcctgcagctcctggtgctgcttgtgtgctccttcggtgaggacctggtacctcttctgtgaagcggcagctgaggagactccggcgctccccatggccggcgaaaagcccaaggaaggagtcaagactgagaacaacgatcatattagtttgaaggtggcggggcaggatagttctgtggtgcagtttgattaaaaggcatatgtcgggcgcggtggctcacacctgtaattctagcactttgggaggctgaggcaggcagatcacctgaggtcaggagttcgagaccagactggccaaaatggtgaaaccccgtctctactaaaaatacaacaacaacaacaaaaattagccggacgtagtggcacatgcctgtaatcctagctactcaggaggctgaggtgggagaattgcttgaaccaaggaggcagaggttgcagtgggctgagattgtgccattgcactccagctggggcgacaacagcaaaactccgcctcaaaacaaacaaacaaacaaacaaacaaatgaaaaaaactaagaggcatacatcacttagtaaactaatgaaagcgtattgtgaatgatagggattgtcaatgaggcagatcagattccgatttgacaggcaacaaatcaatgaaacagacacacctgcacagtttgaaatagaggatgaagatacaattgatgtgttccaacagcagaggggaggtgtctactgagaagggaagctgcttcgttactccaggactgttttcttttcagaccaacatgacattctcagttagaaaactgcaatttggttctaccacattctgactactacagtatagttttctctattatttaatttcccccttccccattcctttattgcacataaagtaactggcatatgtgcacaagcatattgcattttttaactaaacagccaatggtatgttttgattgacatcacatggagacgggatagggaaaaatactgattgtgtgaaaatgccccctttctcctttagtggcatgctcactcagctcttatctttctattctagtaagttattttgcttttactgttttaacaaaacaacaacataaaaatccttgtataccttgttcaattggagaattttaatgtttttcatttatccttgttaaaccaaggacggttttataactcttttgtatgtagctgttacgtgtaggggaatctgtctttaagtagggataaattactctaaaacaaacaaaaaaagtaatcctatggctggactcagtggctcacacctgtaatcctagcagtttgggaggccgaggcaggcagatcacttgaggtcaggagttcaaaaccagcctggccaacatggtaaaaccctgtctctactaaaaattcaaaaagaattagctgggtgtgcctgtaatctcagctactcgggaggctgaggtgggagaatcacttgaacccgggaggtagaggttgcagtgagccgagatcgggccactgcactgctacagagcaaaactctgtctcaaaaaaaaaaaaagaatcctagatacttttctcttcacatatcttgtttaaataaactttttgcttaaaatttaaaaaaaaaataataattgttgtgcaaaccaaaacgagtatgtgggatgttacatgaatttctctttggtcagatttatatagaggtgagactaagtcacagagaattgcttttattatgcctgaggaatgcatcttaaacatgggacatgctgctcaaaaacgggcctaactttgttagatgttttaaggaaactaaggttccacatccatgtgcctacctgccaactgggcacacccacaccatatctcataggcacttgccccagactgaggtaatctttctcatcaaaactgctctctttctagtcttccccatttctgtgaattaggtatcatcactcatcagttgccaagcttgaaatctgggcatcttccttgcccccttcatttttctcacaacctcccacatctaataaaaattaacaaggcctctgtctgtccactgcaagacttttacacaaatgttcaaagcagaattattcatcatagaccaaatgtgggaataatccaagtgttcatcaacttgtaaatagaaaaatgaaatgttgtatttctacacaatagaatactattctacaataaacaggaattaactattgaaacatgctacaacacagacggacctcaaaaacattatgctaagtaaaggaagccagacacaaaagattacatattgtgattcaagttatttgaaatatctagaaaaggaaaatctatagagacaaaaaggagatcagtgatgcctgggttagggggtgggagcagggattgggcatgagggaattttgggggtgatgaaaatgtcctaaacctggattatagtgatggttgcaaaactctatccatttactaaaaatcattgaattgtatacttttttttaaaaaaggcattttatttgaaaaataacttagatattttatattgaatcaaacagatttattatagaaagaaaagcaaagggcataactgtataaatcaagaaagagattttggctaggtgcagtggcacatgcctgtaatcctagcactttgggaggccaaggcgggtggatcacttgagctcaggaacttagaccaccctgggcaatatggcaaaaccctctctctactaaacatacaaaaattagccgggcatggtggtgcatgcctgtggtctcagatacttgggagattgaagtgggaggatcacttgagcctgggaggtcacagtgagctgagatcatgccactgcaccccaggctgggtgcagagtaagaccctgtttcaaaaataaataaataaataaaaataaaagagttcaagaagattaacaagacctatccactccattttctaatttgtctccctatcctcacctcccttttaatcccctctgctattaccctagtttagcctatttatttgtttgttcaacaaacatttgaccacctactatgtgccagccactttcctagatgcttgaggtatagtaaacaaaccaagcagacccctggcctcatggagcttacatattggcaatagaggggccagcatcacctccaggtgtactcccacgactgtgccctaactgttctccctacctctggccttgccccactccatcagtgtccactacaaccatagtgatccttcaagaatgcagatctgatcctgtccctctgcttaaaaacttccaatggcttccagttgccttttggataaacttcaaactcctaaccaggacttgactgtagctgtgtatctggagccggccaggcctttgtgcccaggctgtgtgtgccagctgtagccacttcctcctttgtgctctcctccatccatactggcatcttccctttcctgggtctgccagccctcttcattctctttgctaacctaactcccatttaatctctatatctctgtttagaatccttttgcaatccctcagttccagtttagggggccttcctatagttccccagtctgccagacagatttcatcacacagttcccatggaaaagagatgcacaataaaacatgttaataaaacacgttaggtgaatgaacacccagaaagaaacatctagagagagacaggttgagccaatacaggttaagtatctcttatcctacatgcttggaaccagaagtgttttggatttcagatttttaaaaattttttttggattttgatatttttgcattatatatttaccagctgagcatcccttatccaaaaatccaaaatccacagtgctccagtgaagatttcctttgggcatcacgtcagtgctcaaaaagtttcagattttggggcagtttggatttcagatttttgtattagggatactcaacatatattgacttttgttacttatgtgataccatagcccccacatttaagggaaagagtgtttttcagagttaggaaacaggagctttatatacaatttccatgaaggacacagtgagaaagaaagtcaagatgatttatccctctaaaaaaaatgaacatagcaagattttccgttctaattctataaatgagattaacaatgaagtgatatgcatacaaagtgctaaggttatttggttaaaagaaactaaggtaatattttcggagagaaaagaaaaccagagaataattctatccctattgttggcattgaggatattgcttcagcaggcatatatcttaaatgttttaattaaattctttttactggaacttactctgttacttcaaattagggaccaaaaaaaaaaaaaaaaaaagaataccgtttctctctgctcaccagcttcttttgataggaacagtaagcttaaactatgtggcaagttgacttgaaacttagttactccccaaagaaaagctactgatatgtcaccattttgtaaaggatacatgcattttttttgttttttagaccaagtctcgctctgtcacccaggctagagtgcagtggcgtgatctcagctcactgctagctccgcctcctgggttcacaccattctcctgcctcaacctcctgagtagttgggactacaggctcccgccaccacgcctggctaattttttgtatttttagtaaagacagggtttcaccatgttagccaggatggtctcatctcctgacctcgtgatccgcctgcctcggcctcccaaagtgctgggattacagggtatggtggctcatgcccggccggatacatgcattttaatttggtgaaaaaatattacttgcattaaggggattctgcctcattgcccttaaaaaagttctcttccctacaaatttccaaactaaagggagcatacatcaaaacaacatttgctgtttgtcgctttgatcaagaaacacccatttcaaaaataaactcaaaactaggccagattttttgaaaagtcccttccctaattaaatcagtcaatataaacagcttagcctccccactggataagaaagaaaaagtgggatggggtgagggtgggtaggtagcccaggtaataagtaattgagttgggttccttaagcttctcattttgcctgtcgccatgactgtcttcaacggttagctctatgaatctctatcagacttgagttggaatcacactgtgtgattagggacttaatatagtcttatttgggtcttcaaaagcttcttttgccattatatattataccaaggtaattttaaaaataatcttattggccaatggtttagaaagaaagattttttttttctgaagaagatccacagttctcctctctgtttctgtaaagtcttatatttttctgttttttgtcctttttgtctacataaagagaaaggatgtttaagagtaactgctaggcagcttgctgagagaaaaaagccaagggtggaggagtggggtggggtttaaatagcagccaaattgagcaatagtgtattttcctcttcagaatgaattaggctattttcttctttttcatacttgttctttactgtgtttttgttaaaaaaaattttaattgtgatgaaaaatacataacataaaatttaccaccttcaccacttataagcgtgcaattcagtagtattaagtatattcacattgtggtacaacagatctcctgaactttttcatcttgcaaaactgaaactctatatccattaaacaacccccgtgtccccactttactgttgtgttttaaaaatatttatttatttgtttattttgagacagggtttcactttgttgcctaagctagactgcagtggcgcaatcgtagctcactgtaacattgaactcctggggtcaagtgatcctcctgcctcagactcccaagtagctaggattacaggtatgtgccaccacacccaactactttttttttcttttgtagagacaggggtcttgctatgttgaccaggctggtctgaaactcctggcctcaagcgatcctcccacctctacttcccaaagtgctaggattacaggcatgagccaccatgcccagccttactgttgtttgtaaattagaattaaaaagatggacttttctgattctgtataatgttttcatcaattcatatgtcgaaaagtcaaaattttaaagtatttttaatataagagatacctgttttctatgaacagtgatcctatatttctataggttatttatcttttcttctctcctacacattttcaggtaggtgagacaggaactcattcacatccttgaatctttagccacctctctgactcctcataacgtgaggattgaggctgagttgtcctctaatagcaggaagcagaataatccttttttcctagatcatatgtcaaatttattttcttctctctctttctctttctttctttctttccttccttccttccttttttttttttttttttttttgttttgacacagggtcttgctccattgcccaggctgccacaatctcagctcactgcaaacgctgcgtccccaggctcaagtgatcctcccacctcagcctcccaagtagctgggactacaggcacacatcaccatgcccagctaatttttgcattttttgtagagccagggtttctccatgttgcccaggctggtcttgaacttctgggctcaagtgatccgcctgcctcggcctcccaaagtgctgggattacaggcgtgagccaccacacccggccatgtcaagtttctagaagccatttcttaccttctccccactcatcctccccattccccccactcttcagcaactgtggcatactagtctctggtcttagggttcataccggctgccaggggtccttcttgggttggctccagttttctgaaatctggcagttagttaataagaaaacgagggatataaataatgggcttagacagtttcctctgggtatgcttttaggttctgtcagatttattcattcctacacatgaggaagagaccaatgttcccttcagacatgaatatgaacatagaccagagataaacaaggtggggtgtgtgtagggagtaggagggaagctcaaagtccagatgcgtattagcaccggtgaaaacacacccatttatgaagaacagggatctcatgctggataaggggacaaaaagcagaattcttaacctggcaactaccatactgacagaagcagggttctcactcattaattcatgatattgaagtaccactggtatttctaaaaacagttttcaaagcattatttgttttgtgatctcagtagtttgaaaactccaaaggaatgtttattggagatctattatctaccatgccttgtactagacactgtaggtacccagaagagtaagaaagatgtagtcccttccctcaagaatcttactgtctagttgtcaaaatcctggagtatattataagtagaggccaggcgcgatggctgatgcccataatcccagcactctggaaggccaagatgggaggatcacttgaggccaggaattcaagaccagcctaggcaacatagaggccccatttttataaaaaatttaaagattatctggtcatgatgatgtgtgcctgtagtctcacttactcaggagtctgaggcagaagaatcccttaagcccaaggatccctctgaggctgcagtgagctgcgatcatgccactgtaatccagcctgggtgacagagtgagaccctgtcatcaatcaatcattagatacgtagttagaggatagatagataggtaggtaagtagatagatgatagcagagaaggctgagagctgatacaggctgaggaacaaagtcaggggaccctaaagttattcaagggattaaacaggataaggaaaataaagcactcagcagacttcctgagacactggtcaataaatggaagttgttgtcagtagcaagaataatattcagataaattagctccaggagtagatctcgttgggaatacagggcatacgcatatgcttctcagcagttttatgacaagtaccaaaaatttggttcataaattcagggaaaaaatggctggagcaactgggaaaagatcttggaagaatgggacttacaaaaacaaagggggacaaggaggatagcctagccttataaaaatgagatggtgggcatgtgtctagtgttttaggaacatgaattcaaccatacctgtgtgtgctattcaccatgtggcatcagagatgaatgaggcagaatccctgctcctaaaacacttttcatctaggaggaagatttttgttttaatggtatcaatagatttattaaagttaaaacgtgataaaggctatagtagatgattgaatgatgcagttttgaacacttagaagagagagaagttgcttttggatgaggatcagaggcatttcattgagaaaggaatatattttgcaggtcctgggaggttggctagaatttccatagcagagattggcgttaaggaaaggatcgaaacccagacaaaggaaaatggaggagggaaaccagggcatgcttgtaaaatggtaattattcgactcattaaaggtcgttagaaaaactctgacccttggagagcgagaccatcctggctaacacagtgaaaccctgtctctactaaaaatacaaaaaattagccggacatgatggccggcgcctgtagtcccagctactcgggaggctgaggcaggagaatggcgtgaacccgggaggcggagcttgcagtgagcagagatggcgccactgcactccagcctgggcgacagagcgagactccgtctcacaaaaaaaaaaaaaaaaaaaaaaaggaaaaggaaaaagaaaatttctgaccgttatagcttagccagttaggatgaaatcaggcaaagttatgtgaaaaggtacaatttttaaagaaaatttgaataaattcccatttactgaggaaaaatcattctagagacatctggggctttgtccatcccccattagacttacgaggtaaaaagggtttagaagtagcttggtttttcttagtgccctgaataggaataaagtatttgcctgtacagaatgaatgtgtccactttcctttaccttctaggagatagcaaactttgtcctcttattaaaatagtttaacctacagcacatcttggttatccagggtggtgtgagagaaaagcacgggctttggggttgggcagacttctctgagtcttcattctctcccttctttactgttggaccttgggaagttacttaaaagttgagcttcgttttctcttctataaaacaggactgataatagctaccttaaggtattattgtaaaaattagaaagaaagtatataaataaccaggcgaggtgaatgaccaggcagcacaaaatacatggtggctgcttctcttaccaatagacaatggcgcaactctttgtgggcaagtgtgtctgtctgtattgccatgatttttggtttaccatcaagaaatggcagccaagagcctgctagaatctgctcaggactctgttatcttcttgcctttggccaatacaagcacatgttggacaccgcccaaatgtgcccactataagaattttaaaagtatatttttcccccatcttatcttttcgtttctaggcaagagcgctaaagtatgtggcataatactcacatccggcttggagtagaacagtttcctgaacacctacggggagaaagttgtgcttaaaagcaaataaactggaaagtcaagaaaaattttcctcttgcgtgaatctgcttgtgaaagtctaaaataaaatgtgtgatttgaggcaaatgaaagagatcctagaaaattaagtactctgaagagttatcgtggtggttactggctagaatccctcttagaagcacattgtctgtaggtttttagagaataagagaggtgaattagcttttttaagtcaacaattaaagtgagactgccaacaaaagtaaacaggagctacatttaatttctgtttttcctttgagagccaaggaggccagcacttcaagtccaatgaaactgctaactagctaatggaaaatttttcttttcaaacataaatattaaggtttacaagtaaagataagggtttttttgttgacatagagcaccaaataagacttagccccttttagaaaatttgtggacattcaatatcatattgtctggacctcagtaggagtaaatcatcaaaggaagtcatttgcatttcaggaaccccaattagttttaccctagcaacttttcttgcttttatctcttgaagtttatttttcatggcactttgggttttcttaaagcagtgtatggcaatgttgatgacctttaaatatttatatgtagtcaagactttatataccaaagtcttaagaagacaactgagtcagtcggatgggtgttttgatgctatgaataaaattgaaaggcccaaaattctgatatgacgcaaagacatgaagtgccaaatcaataagcaattttattttttatttatttttttgagacgaagtcttgcttttgttcctcaggctggagtgcaatggcgcgatcctggctcactgcaacctccgcctcccaggttcaagcaattctcctgcctcagcctcccgagtagctgggattacaggtgcctgccaccatgcccggctaattttttgtattttaagtagagacagggtttcaccatgttggccaggctggtctcaaactcctgacctcaggtcatctgcctgcctcggcctcccaaagtgctgggattacaggcatgagccaccccacccagccgagcaattttttttaaaagtaattttagttttgttgttgatgttttttattgttatgaagaaatcgttggtgtatttgatgattctcttggtcagcgaagctgctcttaacaataaataagtgataagtttgtagcaatggaaaaacatgattctaccagtcattaaaacagatttctacaagtcatttgttcaacttgcatgccagtttatgacagtgtcacctttctctatttctagttctcctgtctccttacttatcacataagattagagtcagatacctcaacctagtcttaaaatcccccacccactgccctccaggcacgctagtgtcttccatcccaggtctactcttggcctagtctttcatccttttcatctcattatctcctacactgtttccctggctctttttccccacccagtcatcaggcagcttctcagacagggaagcagtatttgttaaaatacaagttgtaagccaaggataggaactgtaccaaattccatgcttaaatcttctatgcttccccttcctcatagctcccccaagcctttacttatcttcatctatgtcgttaaaacatgaatatttttctagaagaaaaaaaaaagcttccattagaacatatgggattatgccccagaaaagattcagtcctcaagtcttgtgctttttggacatcatcaattaaaatactcacttgtctcaacagaaaataatattctcacttctgctcaggcaaaggttaggttctgaatgccatccagctcagcctgtccatcctgcacataaccacctccccacactccccaggcacattctcctcggtgacaaggacctaccggtatttgaatgcactccagttgaacccatgctgttaaggacctgtcacttgtggagttttacctttcaggattctgggccatcattactcattgtcacctagatcacatgtctttttcaaagagtcaaatgcccttcacataccaagcacacttcactttcttccagaaggttgtcgccactaacaggaggtggcagctgttagtaattcacatcaaccctgttgagagcttcaaggttgaaaaggaaaaacactttctccagcgcaaacaaccagaatcagttttaagctggtgaggttttgttgtttggattgcagcttgacctataccttttttttttttttttgagacggagtctcgctctgttgcccagactggagtacagtggcgcaatctcttctcactgcaagctccgcctcctgggttcacgccattctcctgcctcagcctaccgagtagctgggactacaggcgcccaccaccacgcccggctaattttttgtattttagtagacacggggtttcactgtgttagccaggttggtcttgatctcctgacctcacgatctgcccgcctcggcctcccaaagtactgggattacaggcgtaagccactgtacctggcccgacctataccttttacaagtgaatttacaaagtggattttcttctctgaaattttgctcggggaccaaaatttaaataaataccataagtgaaagacattaccctatttctcccacataatcgtcactcacccccatacatgttaagtgctgcctgattaataagagctaaaattcaataagcacttcctttatagcagggactatcctaagtgcttcatataaagtattacatctagaacttcagcaactctgtgattcagattcaatgtttagctaccattttgtaggtgagaaactgcttcatggggtaagtggtcatcacaagatcacatcataagcgctgcagccaggactcaaatttacctattctgcttcagagactacacttttaaccattaattccatgatgcaatactgtctcaactgaaatgggattccaccttggtggcaaagtcattatgatcaaaatcaatgagcccggcacctcccattcaatatcctccccatgctgtcagcatgacttcttgaacagtgcagatctgatcatgacactggtataaaagttgtagtgatttctctttgcctacaaaataaagtacagatcttgaagatggcctaaagggccattatcttccaccatctgcctctccatctatatcaactgccacctgcccatgccctagtgatgtcacttgcagttccacaactggcctgtgctgtttgatgctttgagatcttcaaactttctgccctgaactattcctcccctcctcttagttagcaagttcatgcacatccttcagaacctctcccaagcatgtcctgtgcatccttccctgacataaatatcctctcctctgtttgctaccaacacatagaactatttatcaaaattatcatagccactattttcagctctcatgtgccaggcatagtattgaacacttagcatgtttgctgggtacaaatattgaaccacagacataattaagggagaaatgttactgtttctttaaaaaaaaaaaactgaccataatttctattttgagacctcattcagctgggagacagaaacttagtatcagccaattcaggatcccctctagctcctggggttgcagctaagttgtaagaagcttaggcagagtctagggtgtgtgtgtgtgtgtgtgtgtgtgtgtgtgtgtgtgtgtatgtgtctggatgagattgaacctttggtatccttgtcaccattccccatgctagtgtctggttggtgtctggtgtcgggatgttggtatctgcagccttttcagatggattaggaatctgtgccctcttggattaccagaaacaatttgcctctcctgaaccactttggactggaaagattggtggaaggtataacactctctccagcccaggtgtaccacacagacatttctttcattcccactccatgctgggctcgcagggactctgggactgagtcagttctccggagtcttgcctgggaccagggcccacatcctttgtgccctcaactctctgcttctctggagctttcatcttgccctacataacactcctaactcccctccactttccctctggctctccttgcctttctttgttagtcctagaaagctgtaatgtctgctgggaagaaaaactggctctaattgagtattcttgcacatcttaagtcgggcacatgcattcctttgttctatgagttctgttgtgttcccttgtttttctttggtcagtgaatgacactgactgggaagaaagatgaaggttactggaaaagtcaatgttatgagtaagcagttaatatctcactgttaccttggccccaaacacacacactcaatgattatcccatattaatttttataaaaaccttctgtggaagatgtaattaccattttcacagaggaaaaactgaggcttagtgagatcaactgacgtcacccccagcaggcaagatcttgaattcagtccgcacttttgaccaccacactccaccatccttagcacatgggactgaaataatttctttagatacctgggttttccactacactgtgagttccttgaagttagggttggacctcatccatcttgatatccctatccctggcatataacaggttctcagtaggtggcagttgaattgaaatgggtcaaggagagagaaaggaaaggtaagaaggaaaaaaaaaaaggagaatgagaaaattcccttatcttaagctattttgaaacttcctgaatgatactctgccagctaaaatataagtggaatgaaaagtttgatgattatctaagtcacgtctagcactgagctctccttatattatgctgtcaaattattctagccatagaaattaattccttgtctccaggaaagaaaagggtataatgtggttggtgacatagcaatgacaagtgaggaaaatgtgcatatgtgagcagtgaccagtgtggacagtttttaccagtcaatgcagtaatagctgatttttatttacttttctagacagtaccatccaagatgctggtggcatataaatctgataacttgaggaatttcacagctttccattaaaattttatctgaaagcccttgttttaccacattacataaaagcctctgataacaagtatcatatttatttgcccatgaatgtaggtgaagggtagaagttttaggctgtgacatgcccaagttacagtcaacgtagttttgctgaatagtttttttttcataatcatctattatgtgttttattttttaaaaaaattttatttgatgttgtaacagataactagaacacaacataaatgaaaccataaagttaatcatttctctgccccacctttcccaggtaacttatattaacagcctggggtgtgttcttccttggtcatgtaatgtttgtgttctcgcacaaattctcattcatagaagtttgctttttctccttatagtgtttctcctgacctccttccttgcctttaccctccagcgaatttccctcattctttccccctttctcttccccattcctcctccatctcttttctctctctctttcttccccttctctatttttcattttctacctttttttctttctttctccgttagccttggaggacccaggctcttggaaaattgcatttatcttcaaggtgtgacagttcagttgagttttgactctgaacatttttcttgggttgtcttatgcctcagcataagaaaggaatagaaaagggtaggcagaaagtcaaatattcagttaatcaagattaacttatttgatggaactactttagaacccaggatgctttttaaagttattaaaatgtttattatacaaatgtaattcaaagagtaaatcatggttcttgtttttaaaaaatcctcaaagtctatagaagtgtttaaaacaaatgataaatttttatttatctgccagaattcttcttcctgcaatgccactctccaagaagagtttagctttccttcatgaagtttttctggatatttataaaacatgtaacaaatattgtatgtactggtggatgtagacagcaaatgggaagctttttcactagataatgtggacatctctccatgtcagcacatataggacccccttctttcactttaaatgctgcataatatcctttgcaattaatttaactattttctacatgaacatttaggttgcttccaatttacaggatgcatttctaatctttcaaccaagacttcccaaaaagaatgctgtcaattcttgtctccttaatgacttggagctgctgacctgagtgactgttatttaaccagtgacccccatagccttgacagggtcctttgtgttccgtgtctccataaggacaagaacttgctggctaccttcaccctctgaggctatccctgtaggtctcattctgctaatattgttgctctgttctttcctaacctttttgcctctgtttaaacctatacaggtttgatacaggctccatgcgcattgtagttgactgctgtgctaacatactttggtagcatagatagtgaataactctcatctacctagtcctcctctctcttttctttgggttctcacctgtgcaagatagctttcgggataatagccaggatgcattaatgcctttacttgggaccctggggctataaagaacaacagaaaacctggaggtgctttggtcactgtgaaacagctgccacacaaagagaccttatccagagaaagggtgaggccagtatcaactcagaggatctgggggctcactggcctatttacgggaaaagactgtgatagagatgttaaaaggtatttgaaaagacaaagtaactctgagacgctgaaagaaattatagagttttcctccttcatgttcactacatgaaatagatcatttctaaggggttggcatggccttaaatgcatttccctaaagtttccattttaacatcttcttctaggacacctaggatggttgttcacttgtttttcattttgttgtgagtggttccaaaaaatcaaaatatttattaaagtgaatattatgctagaagctatatattgttcacagtaaaccccaacacccatttgagaaagcagcacatcattcgttcctcctaatattttctctcctaagcaaacaatctatgtttcaagtgtgttctttctttgtagtgtgttgtttatattggtcattaaacagttcctaaaactgactttcaacttatatataagttgtttctctaaggtgtcaacattgaaaagaacagtatagagcaggggtgtccaatcttttggcttccctgggacacactggaagaagaagaattgtcttgggccacacataaaatacactaacactaacgatagctgatgagctaaaaaacaaaaaaaaatcacaaaaaaaaaatcccataatgttttaagaaagttcatgaatttgtgctggaccacattcaaagctatcctgggccacatgcggcctgtaagctgagggttggacaagcttggtatagatgaaccagggaatttattgtatgactgtgacaagaaagagttaataattatttagcaaagattcctacatttcaaataattgtttttcacatcaaagctttagttgtaataatagaaggaatgtcaaactgaattggtaagaaataatggtagactatttctaagtaaaatttagtaatattttaaagtataggctgggcacggtggctcacgcctgtaatcccagcattttgggaggctgacacgggcagatcacttgaggtcaggagttcaagaccagcctggccaacatggtgaaacccatctctactaaaagtacaaaaattagccaggcattgtggtatgcacctgtaatcccagctactcgggaggcaggagaatcgcttgaacaagggaggcagaggttgcagtgagctgagattgcaccactgcactccagcctgggtgacagagcgagactccatctcaaaataaaataaaagaaagtatagaagtaagtaatgatagccattttttttttagaggcagcgtcttgctctgttgctcacactggagtgcagtgacacaaccctagctcactgcagcttcaaactcctaggtacaaatgatcctcctgcctcagcctccctattattagtagctaggaccacaggtgcatgccaccacgcctggctaatttttttatttttattttttgtagagatggcgtccccctatgttgcccagactggtcttgagcaatcctcccacctcagcctcccaaagtgctgggattataggcatgagcccagcctcgtagactatttctaagtgaaatttagttgaatattttaaagtataacatatgttacaaaaccaaattgccataatatatataaaaaaagctaaacttgtgaataaattgagaacccaaataatgtatgatttctagatatagtctttttaaatatacaattaattaaatgtattagacttacattgaaaatgtattagactttaaattaagatgaaataattcaaagaataagtgctgaatctagaattttgagatgtatgacaataatctgaaatttctagagctttttgtctgaaaaaagatactcattctcacaggtccctcccaactaatcaactgtagtaaaaaaacaaacttctcaatatctatatgaatcagaccctctgaatatactagatcctcaataagcatactctaatttgatgtgattttaaatatttcttacaggttattatatttatctttcactgacagttggatttgtaggttgaaatgtttaagagagaagggaggaaactgacttggcataaatgcacacagtgctgttctggctgccagtgttgtgggttctgtcactgactccctggttttgactcaggaccacctgcgggaccttgcacacctcagtctggtgtacctctgtgcaggtgggtgctgtgctgctctaggaccatgttggggacttattccagtctctctggtctttccttcccacaacacactccagcaccagaggtggctttggcgaaggaaagggagcaaaaaatgataacctatttaaaaacgtcttttgaaaagtgtaaattttaatggcatgtgaatcatctgtccattaaaatatttaaaataaaaacttttaaacaaaagaaaaaatgtacaaattacaagttccagactggccatgcacaccctttctaagacaggctgtgcacctttttcctatgtgtaactttctcacaaaatattttcgcatttttaaagctttatttcttcattaatatatttgattttaataaaaagtaaaatgctttcgattctaatgtgatgcattatttctgaaagcagtcttaagacaggaactaaagggcagtgtgattttacagagaacatctttaatagtggctgggagtttacacatacacacacttgatatgtgtaactatttcaggtcattctttcgtcttgtggaggaagggacagacaaggagaacggaggtaccagttgagcaaactaacccccagctcatgcagagagacattagcataattttgtattgttgctgaaatttcttcatgtcttacttttgatcccatgagacaagttgtttgcttccatctaaaaatatcggatgatgcctctacattgcagatacaagttaaaagtgtttttccagaatctatgttacaaaggaagcccagggacctctggtcatagtgatgaatttcactggtgtaacatccatgctgtgtgggaggtgagatttggacccaaactgtgtttttaatcaccaatttacagtgatgtttcacacagaagtagagggatctgttccacccttatgagatttcacctgacccagagcacttagaaaacaagataaagcagcagcaggagaggaggccttatctgttctgcccacagagctcctggctgtgttctccagctaatacttcttactcccccccacgcgcaatggcagcggcaatgtgcgttataaactgcaagggctgaccacttcttcaaagcttaagttctggacatcacctccctctcccccaaacaagattgccacaggacacgaggacacagaacaaaccatattaacctctctgcttccaatgcctagcaacaatgtttgtggttaccccatgactgtgtgacagctgtgtatgtgttgatacctgcttgtgataccataggtaaaacaaaatacaattttaaggaggataatactttatggcagggaggagcctgtccatgaaggtttcagtaaagaggtttattcagtggttgccatggctgctaatgctcctgcattctgtcaggatataagagcacagacaagtaaaggtaaatgtggtatcagctgtttggtaagggaggtttctatttcctacctagtgaggtcttctctgtgtctatatgcatatttattaccttaaatatagaacctggacatttaacaacagggattctgcttgaatgagaataaagccaatttcaaaccttactgttactttcatctctggaggtgacacgtgagagcaattaagagaggactctgaggggaaaaaattcctacctccgttgaaagaggctggaagaacctttgaagaaagatgaaacttaaactagcaccatcccttcctttagaatattaactggacgcctatatcataaatgcaaaacaaatgcaaatggatatattttctaaaattccaaagtttgcaaagctgaatccaaaatctctcgaaattacagtcatgacgaccgaaagaatcacgtctcttgtctaatcagagacgatgcttatggaaacaaaaacaggcccggaaggaaggcttcagcggcattcaccaccacctgcatctctgctgtgacttacactgagaagagggcatgctgagaaaaaggatggttattttccttgtaatgcgagctttttttttttttttttagctgtgaactttttaccttgcttcattcatgcttcatttgatcaattactaactgtatagcctctgaaaagcgagcgcgggcttcttaaagttgatattttgcttttggattcctctgcattttacaacggggggaggttaattaaggcacctttctgattgaatgggcagagggactgagggtgtgtgcttcggtccggtccccttaataccgtaaggacccaaggaccgcggaggggcgagtggagcgcgacgcttccaccccagaatccgttttcaaaccttagggagccttctttgccattgaaatgcaaatccggtcctgagctcccgggccaatccgggaggcttcctgtgggattacctggtggcgagcgagcgccgagccagcgccgagccagcgcggcccctcgggtgcggcgggcgcggggtggactgagcgggcccgggcgggacgagaggtgggcgagcgccccgcaccctcggcgcgccgcgcgggatcagcgtcctccagccgcgctgccccggcccaccgtgcagctgtagccgcggcgcggtggcgcggtggcgcagggcgctgctgggccgcccattgttgagcgcgttgggccccgccggcgatgccgcgcgccgcctcctcggagcggcggcgaagtttgaacttggcgtcggcctggagccccgagcagcccgggggcggcggccgcgaggcgagcggcgatggtgagtgaggagggcggctgggcacggagagggaggcgggggccggccggctgctttctggagcgcgtctatttcgggctctgcggcgactctggaaagccctgtctggaggatggctcccaggggctttcacggccagcaccccggctgatgggggcaggtggcgtgctccgagggtctcctgacactcctaggccttggctttttatcagagaggcagtagctgccactccaagaggaaaataattgttgattattgacagcatgaaaacttttcggaagaaatgatctgtgaaatattttaattttgataaattgcttcccaccagggcccctgctgagttgagaactccttgcctttcttaattttactggatttgtttctgtaggaaaggctcctgaagtgcgttgaggggcacgcctacccccaacccccacttgctccagatcttaagacagttacttaaatagtgtgttccttgtgctgcagcaacacttaaatcatgaaaatgaaattctacctgacgctcgctttactccgaattgccagaggaataaaacttttgctggtgggggaggggagtggttacaaaatttcaacacctggagcactctctgggggtgggatgtatttctcttcctctaggatgtattttggcattacctttttcccctctccctttaaatagtagtgttgttgtggcgcactgtgtgcacgggagcttctgcactgggagcaaatgggtgccctgcatgcgggtcatctccatggagagattgctgtgatatcggggggtgcaacaggaagtcctagcacagaggctgccagagagagttctgtgcattttctgtttttaattagttgttttaaagcctagttaaatgtccgtttccagttaaaagcaccctggtcggatatatggctagatctttcccccaaaaaatttcaccagaagttggtttacattttaaatttattttgatggttacctttttttttctgattataaaaatattacacaatcgttgcagaaaaggtgtaatatacagagaaagaaataaactcttataacaacatctatgttttgtttgctaagacctagtttttcacagaatcctagtcatttgaaaacttttcagctatggacttttttttttctccattgctaacaatcctggtttaggaactaaagctaggaattgacaaggaaataaacttacttaaaaaaatgttataaccaacaataacttattcacattgcccatgagttggaacagaatttattgtggcaatttctcttgaatcaacttcccacatctgctcccagcaaatggtttctgtttgtacagcctattttgtaaatacatctctctaccattaaggcgaggtgcccaaacacatacccctttccagtgcttgtggcttggctcatatggttaatatgtttattggcttctgcatcagaacttcctcaccatacatttgataaaaccctggagaaggttaccaagggatgttgtagagaattcacttccctggagattttaagaataggataaacatccatctgcctaggatggcttcagtgcagtactgtctggataaaggaagactaggtcactactctgaacctcaaaattgaggaattctaaaatttgtttagaattcctcaattttgacctgggaccaggtcctctgtgacctgggaccaaagcaaattaaggttgccaaaagtacctgagcccagtaggaggtggagccctgttttgatttatgtgaaacaaagttcttcttttggtaacagatacgttaaattattcttaggagttaccaatccttttctattatggatagaaaatcaacaatgatttaactgctttctgggaaggtataggtgaattacagtataaattctgtgattttaaagtaaatgaactgattcatgggaattaaaagttttgcctgaaaggtgggcagggtgtgtgtgaagagtgtgcctgagttttctccacttttaacctagtgttatttttagaatcctgtcttatgtgttaaatctggttacatttttaaaacatcaacattctactgtctcttcaatgtttattcttgctttcccttttcatgcagaacccatacagacctttgaccaaaatcaattattcttgtaagttctgttcgaggatgtttccctggagtccagcagtgctgaggttttgctggtgacttccagaaggtcaggatttcatgggttgccgcttcttctgactttctgtttgacagaagtatcctgtaattctaaccactgtgtgacctcaattgccttgacaccttcctccccttctgtagtatcacttgaacaggagctgtttcctcctgcaggatcactgagaggggttcactttctagggaaggtcatgtcagaaagaagattgggaggtagagcctggtggctgggcagtcttcaccttgcctgaatgagcaatgcctccatttcacagccttcagcttgtgggatttcttcatgcatgtcagaaactagttttcttatgctgttgtaacacccaaagaaggaataggggcatgaacaatggtcattcatttattcagcaatcatttactgtgtgggaggcatcccaggaactggcgatgggttccctgccctcaggaactcgtcttataagaggcaaaataaaacatgttaataagctagtgccattctgaaggtgtagagtacaggggttaagaaattaagtttgttgtaaagttaaacatacaccaacctatgacccaacatttccacgcctaggtatttacccaagataggtgaaaacaaatgtccaccaatgacttgtacagaatgttcatagcaaccttatttataatgaccaatacctggaaacaaccctacatccatcaacaggaaaatgggtaaagaaacagtggcacatccatacaatgaatacgactcagcgatcaatgggaatgaactcttgatacaaaaacctggatgagtctcaagagcacgttaactgaaagcagccagatacaaaataataataagcaattctattcatgaagtgctagaataggcaaaactaatctatgacagaagtcagtggttgccagtgggtagggactgactagaaagagataagaagggattttctggaatgatggaaatgttttatgttttgtttttcgtgatggtttcataggtatacacaattatccacacccatcgaactgaacacctaagacctgtgcattttattgtatgcaaagcattacctgaattagaagaaaaacttaggttctagagttacacaagagtatacatcccacatctgcctctaggcatatattaccctggacaagatattaaataaatacctctgagctgcaagacattggacaataatagaacatcttcatagggttgttgcaaagattgagttaatgactgaaggtacttagcttagtaagaactcagtaaatgtcaactactatttccaggcactgtgataaatataatatgtgattttggagttgatgaaaaagtatttacacttttgtgaaagccatatcatttaagattatcaaggatcttatattaactggtatccttatcattattactatgcataccttcattttgataagtttgtttttttttttttttttttttttaaagcaacaagacagagtcttgctgtgttgcccaggctggagtgcagtggcacaatcttggctcactgcagcctccacctcccgggttcaagcgattctcctgcctcagcctcccaagtagctgggactacaggcacatgccactatacccagctaattatttttgtatttttagtagagactgggtttcaccatgttggccaggatggtctcaatctcttgacctcgtgatctgcctgccccagcctcccaaagtgctgggattacaggtgtgagccactgcacctggcccttgatgagtcattttttaaggttgtggggatttaaaatgtgaagttcttgtgtacgtgatcaaaatactactggggtttggttttgccagcagaagtaaactccaaagagaggaactacgcactaggcaaactcctttttttttttttttttttcctgaggactgatctgaggactgatttaatgatgattgtcgaagctgagctcccagatgaggctcacaacatcttctgggaatccaaatgaaaggttaacatactatattctcttcccaaagatgtaggtagaaaaaaaaaacaaaactcgatctctctatcaaaattaacgtcatgcttttcagtaaaatgctttggacagagtggtaaatttataatagtttatttaatctattaagcttcagtgatttaatttaagttcaacaaagcatttgggaaagatgttatatattttgccaactccaagtgaggcattttgttgttgggttggtttaattcattcagtaaacatttgtcaaacatttactgagaacgcattagcctctgggaattcaatgatgaataataagacattgtaccctcaagggttcatagacactccagccacaagtgtgaatgtgtacacatttcttttggaatttttctcagagcagagaggtctgtctcaggctagtctttttgtttgtttttttttgtgttttgttgtttgttttaaaagctcctgcttacagtggaggtttaaaatcctagttcttttaattgatgttattttcttaaacattggcatttctcattaaggcttcacttgttattccttactaaaaatagcaaaaacaaaatggtcttatataaaggcaattgagtacagtggaaaggtcagagactgtgcaagtagaatgacctacgtttgaatctgagctctgctacactagtaatttggagagtcctttaagcagctgtttcctcatctgcaagatggtgataatgataccttaagagaggtattaatatttattaggttaaggctgttataaggattaagtgacagaatacatgtaaatataactaggctggcacctgataggtgttaattcctaacatttattgagtacttactaggagtcaagcactgtctaatacgttttgtgctggctgattttatcttcctcacactcctatgaggcaggcactgttactatccccttttaaaggtgaggaaaccaaaatcataggttaaataacttgctgagggcatggaggtgccagggttagtacccaataccatcctgtcaattaatggatgaggtctgtaatagatgtcaactatctttcccttttagatatgattgttttataccaataagtggaactaactagtgccctgcttatggctgcatgcagattaatactggtggtgggggatggttgactccttgaatatgttcttaaatggttaatgggtctaccacctttgggggtttgtgggatgcttgtaggaaaggctctaatgaacatgtcttttcttttcccagcccctcacaagtccacctgtgaggtggtcctctctgacattgtccgttgctccttacccccaatgactccaattaggaagtcagtcgacttatttgtgaacaaaaaattggagaatcatggctgcctattagaatttgacctatgctttgtgaggtctatgtagggatggacatagatgcaatattttcttggtctccaaaaaaatagcaaggtaagaaatgtgccccagagcactgttacagtaagaagaaaagtctaccattgatcctggatatttcatatttcctatttccattggcattttctcaactcccagattctggagaaccttgagctaaaacttaaataaaaataagttccaaatggtacgttgaaaacgctgctgatttaatgaagacgaagtcaccttgaccaattcattaaaataatgtatagatgcccaggggaaaatgtaattaaataaatatggatcctagtatctgttcctatatgagccttttcacttagtttctcccccaaagtcctgagtgtcgtggaagatactctggattattggtcctgacatcaaagcctctccattgcagtgtggagttaactaggcagccagaatctcaggaccatttcctcagccactcaagtggtgccacgttggtctatttccagacccatcgaagaagcccctcagcatgcagagacctttggagacactggactgaaaccagatggtgcagaaagaagcccctaagcaaagtgttgcttgcagccctgtatttgaaagagtgccactgtgtaccaattatgtccatccaaatgagccgtattattttggggcaaaatgactgggaaatgaaattattaggactctgctctctgatggggaaaaaataaatctggaagaagaacctacaaggatcttagctgtctgcttgtctctgacactctcgaggccttgtgccaggctgctttgctgtgcaaaagctccacttcagtcttttagtctgactcacaatagacgcacatggttgaagttaggagaattgcaggactgtcacttgaagtccctctcagcctcttcaccatcgcccccagcctctttccctctaacattaagccctttgtgtcggttcccatggttacctcctcactactggcagctggaatgtgatagtgagaggaggctgcctcccctactgagccaggtctggctggggcggaggccattgatccgcagctggatttgtgaaatggggtcacagtccagtaccttctctttgtcgtgggttctatacctttcccaggcttgacatatcagggttgcagtgggaggggacatggtgggtgatggactgctcacaggacatgtcctgtcataggctggcctggcctggcgtccctgacctgccaaactcctccctgaggtcacccttccatgtgtgaatgcccattgagggggaaggggctgctctgcttggtcaaataaaaatgatgactcacttctctacctgctttctgctcagattctgttcccaataccatctgttcttaagttagtcaacattaacaagggtgggctccagtctggaaagaatttgcatcaaaggcatgttttcacatccagcttggaagaccaggcaggctctgggaactgggggatagcatagggattcaaggttcaagatgaaaacaaaactagccgagaggtttttgttgttgtttttataagagacagggtcttgttctgttgcccaagtggggtgcagtggtgcaatcatatctcactgcaacctcgaactcctgggctcaaacaatcctcccatctcagcttcctgagtaactaggaccacaggcacatgccaccgcacccagctaattaatttttttttttttttttttggtaagagatgaggtctcactgtgttgcccaggctggtctcaaattcctggcctcaagtgatcctcccaccttgacctcccaaaacactgggattaaggtgtcagccactgtactctgccccgagagtttgtcttgaagctatttcctgacatactatttggaggcttcttaaattccttctcatttagagtctggtgggccccagagttgaggcaggacttggaattacaggtggaaattaagcagccctggtggtgagggtgaggggaggtagtttctagtagaaagcaccaaaaatcaacactcctgaggaattcaatactggaagaattgttatgctcttcttggaacaaggcaaatctgttttcagagatctttcagccctgtaggtatctaactaagcacttaagtgatgcgattgtgggagaaggcagttaagggcacactctggagccttataataggttgggtccaagctttaccacttcctttgtgatcttgagcaggttatttaagttacgtttgcttcagtttctttttctgtgaaatgaggacagcatttcagagggttgctgtaaagattaaatttgttatgtaaaaatactttgcatgttgtacagccagcacaggtgccaattgtaatgtttttaaatgttttgagaatgtcatgctaaactgaggacatagattttatcagttctactttgtggtatgtatgtcagtgggtccagaattcccctggagagcacaggaaagtgctggggtgagcaggaacatacaggatgaggaaaaaaagaattcaagcatttatgacactaccctatagtaactaagagaaaggaaaaatgaaggggataagtagaaaatcagcccatggaactatagtcacaaacacttagaaaaggtctactgtaagctgtaaaccattacttttccacaaatgggctgcagtttggtaccttgatgtccatgtaaattgtgctcccaaagaatataaagtaaccactgggaaaagctgagtccccctttgggtgatagcaaaggttggaaacatttaggtttgatatttggaggcatttaaatagcatggaatgtctattatataccctaaaaagcagaacgaatcttggatattatggacacaaatgcatttggcatgagcttaaaaaaagtgcatgtgagcttctttctaagacccaataatcctcttgggcaaagtaaggattaggcctccctcacaaacaaggcagggagttcatttttgctaagattcctcagctgatgccaaatttagcaagggacccattttttcccaatgaatgacaatctccatttacatttttaatgtccactcctttaggcaggtctagggctggagcaacttatttgcatatagataggagacaggaccctggctcctacagactacattgggaccctcagagaccttcctgagccagagtccctttacctcactcgcttacaaaaggggaggggtctcctaccccagagcctgaagtaggaaggactcaggggctgaaaaaagctggggccaaactcattctgttttaaagacagccttgaagatgcattcaccaacagccatccctgcctagtgcctgcgactcctgccagtgagaggtggcctctaggcagctcctctaggttaattctgtcatccttgaccttgaggagccctttctttcacaccactcactgggtcctctatatctattcccaaggagctcaggtaatgccctatattttctgttcttatctgcaaaaaaacccctccactttggatttaaatatttatattcctccccaaatgttttgggcaatttgtagttgccctttttaaggaattaacccatcaagacaccaccatcctgtcaccctccccatggtgactttccacatccatctcccttatgcaggccatgttgattgaacaatgatagcacctgtcttgcagtggttattaagccacagggtagataatactttgtcccctttttacagatgaggtcctgaggttcagagagaatagtggccaggaactggcagagatcagattagaacccaggttgatccagctacaaatcctttgtgtgcctccccaacaagactggaggtcagaagctgtcttttattctacaccaattccaactcggagcctgcatgtagaacatgctcatcccttgttgatgtaggtacgcagatcatgttttctcacttgggatttgccatgtaggccctccccctgctttttacctttggttcatcaactgtcaaaggtaaagggacccccaggctcatctgtactaacctcctcattttacacatgagaaaatagtagcccagaacatgaaaatgacttgctcatagcaattacagagacggccttgtgcaggtgtcctggctgcaggtccagtaatgtttcctgctataatagggtatgtatatatggccttttagagggtctacttaaccatccgtgctcccttccctgatgttttgtgggaacagggaagaaggattaccaaatcgactttcctgctttacttccaccgtgcttgttgcatgttctctttcttgctcctttccacaagtagctcctttccaaagtgcttttctggagatgattaatggtactacaccatgcagcatagtctaggagaggcatgtcagaggtatttggactgggatgtgttctatgtgaccccagctttaccctttgatgagactcccctgatgcaggatgttagccctttgtggcttcagctgagggtctgagcgttggctgagttatattcacattgatgtagtccaagcagaatatcagcaacagagctgtactctgggaagacagtaattcccattcgaatgagacaggatagataactgcagggaacccatcaggaagctggcctcgtgtccactcggcatatttttattaaccaaatacttattgggcatcatccaaggaagagaaccatatggggccaaggaagaaaggagaatctcaaataagattaagactatgacatcatagttaagagcatagactttgtcatcagccagatctggagtcaaattcttttttcaccagcatttggacaaacttcctgcacttctttgagtctgtttcctcatgaataaagtagggactaatagcagaaagtcacctgccttcaaggttggctgtaaggatggtaagaagctgtgcagaaacagtttggcccccagcctggctcagagcactccataaggtaatggcaactttgaggactgatgcttggatacctgccctccctggggcatgcgactgggggaagcaagtgtctacaccgactgtgtaaaagtgaatgacaaggagagggaggcatgctgagtgtgggctgctctcatggtctcttttcccaggacttatggcgtgtatgtatatatttattcagttaattttggctttcttcccattaatttataattccacaaagggaaggatcgtgtctgttttgccacgagtccagtgcctaatccaatgtgtggcctgtggttagcccttagcaatagttgattgaatgaatggatgattgggctaggtatagatgtgactaggctctgggtttcagcatgaaatatcttttttttttctttctttctttcttttatttatttatttatttttgagacagagtctcactctgtcacccaggctggagtgcagtggcatgatctcagctcattgcaaccttcctccacctcctgggttcaagtggttctcatgcctcagcctcctgagtagctgggattacaggtgtgagccaccacaaccagctagtttttgtatttttaatagagatagtgtttcaccatgttgaccaggttggtctcaaactcctgacctcaagtgatctgcctgctttggcctcccaaagtgctgggattagaggcgtgagccactgcacctggccttgaaatatctatcttaatatatcctgcatcatttcagcagtgtgaccggcgctagaaagttcttgtaggggcaggaatgctgtctgggtgtcaggggtagggacttcatcatttctctagatctagggacagttggacttgagagaggggtctcatctgaatttcagtcagtctactttcttcttctgaagcttcccctttaaagaggcttttggtattaaatgtttgctactgtatcaatggacttttaggatcacagaatccaaaggcagtatggaacaagagagcttaaaaattagagtatgagaccctgctgtgccagtcgtgtggcttagaagtcctgaccttgagcgaataactgtccctctatgaggctgtctctgcatctgttaaatggggataaataatacttgctttacttgccttttaggattattgagggccaaatgaaataatgtttgggaagtgctttataagctataatctggtattaaagtaatgaataatggttcgctgtagagatttgtattgttctctgggaacactagtctgttactgtaggctaatgatagaggatagggaaagaaaggcctagactgaattttttcaggaggtatttgtctctctctactgatactagtttcacagaaaccctgcttcttcctccactggctattttcagcagttattggagctctcaaagtaatccccttcaccaactagtgtggagtctttctgctgcccacatatgctctcaggataggcacttccatttcctagagaagatgttcctttaaaaatgtagaaaatttagacccttagactcattctattaagaaaaaataaggctaattttactattatctgataattaaaataataaacattaattgtaaacaatttgcaagacatagaaaagagagaagaaaaatagtacccataatcctgtcacccagtagtaacattttggaatacttgctggtgttttgtttttatgcatatgttttatctcatatgaataacaaaagagtgatgtggaaaaattaaaggcatacatggtttgatatgtggttgatacctaccaaagtatacaaagcccagtaatcctaaaaggaatctaatggggtaggtagtggagagggtgaggcctttagccatagctctttctactttttaatttaatttttcttttcttctttacaataaggatgattattgcctcaaatgataagaagattaactgaattactgtttttaaagcacaaataatctggtacataccatgtgcccagtaaatgtaagtttcagttctacgggtaaaaatttaataattattgccaggcactgttctgattgctttatacatattaattcattcaagcctcacatctaccctttgatgaaggtgctattagtattcttattttataggggaaaaaacaggcataagaggttaagtgacctgctcaaacaccttcctaggtgacagagccagaacaggaccccaggcagctggctccggaatccacatcgtccatatacattacacagcctgctgcttgttggagttgtcttaagatctaggctctgagtgcttgtagctaggggcacaccgcttccatgaagatatcatctgttcactataaagcccttgtgagagcccttggttttcttatgcacttgtcctgggctactagctgtgtcaaagggctcagtgggtagagggactgatgtcagcagtaaactgaagcagattaatatttattaggcaggttaaaagatttggcaggtcatttggctttttctcctatccaccctttcctcatctttctgcaaggttgacatagaggtcattggctaagatctggagataattaagcttacggtttcagaaagagtcagaaatatgctgaatgttactggggtatattgtacacctggatttgtttggcaagtttcagggggaaatcaagtgaaaaaaagcagcagccagagcaggaggtgcaaatggacagaggtttgagacatacaaagtgcatctctgcagagctgaagggttatgtgtggccctcctgtaataaaacaagctgtagaccagggtaggtaagcagaaagacaggaggaggctttaagtacaaatgaatggcatgcctatgactaaaacactagataggatacaggcctgagggcatgcagagggagcttcctagatggtaaataatgacttaaaaaggaaaaaagatgagtaatgagaggacaggacccagaaggttaagacttaaatgtgtaagttacaaaaggtcagtaacaggaacaagggggccttttaaagaaagggtaattcattgagatgtctgtgaaacggctgatcaatggtcagttatcagaaaatgaagagcacctatgtttggctaagaacagaaatctgtgcctgagggcatcacttcttaaaatcttcttcagacactgaaaaagcttctaatctaaggccttttcagcctcctggagactcaagagaaaaagtgctgagaaacctacaactatggcattagagacctgcaaacccaggagaagggggatgacaggatagagatgcaatagtaaggctaacttcatggatgaaggacacagagtagaaggaaaacttgaaaaccaagaacgtggctttaaataagacaaattgccacatgaatgagtgtacacacccaacataaatcaaaaggaatttctccaaaggattctgaggacaaacttagccctgtataaatgcatcctgtctacttaatcacaaaaagcattctgattgcctccaaacataaggcaacaaaattgcactgagccataccagctgtttgtcgaaggggctctgccacagtctcccaactcccaacttttcttgtctgtcccaagaaagcctgccgctaatgagatggatcaaaagttagggctagattctattttcaagaagaaatcaactcagagcctgatctagaaagtaactagaagaaaagaagatcccacatttcccaaaatagatattatgaacagtttaatgcccttatggatttaaggacatagaactttgttttggatgcattacaattatttcctttacaggttcctatgattcattcagcaaatatgcattgtgtgcctaccaggagacactcactgtgctaggccttgggtgtgtagaagtttcaaaaaacaaggctgaagaaaagccagaggtggaccctgacctggctgagcttatgtcttaacaacgaagcagacaatgcacaagtgaacaatttcatgtggttataagtgcagtaaagggaaagatcaggtgccaggaaagagtatttgcattagataaggcagtctccgaggaggtgatgttccagctgggagcagaaactaaggagtggtcagccaagaaatgaattgggaagaatattccaggcttagagaacagcatgtgcaaaaagcaaagagcttggcaagtttggggaacctaaggaaggccagtgaggtcagaatgcagtaaggggaaaggttgaaggaggggcaggagccacgtcaccagagaccttgcaggccaagtaggggaacctggattttatccaaaatgcatagggaagctacaggatttcatcagggaatgacatcatccatttacattttttgaaaggctgctgggtagacactggattggaggggacagaagtggaagggggaggccagtgaggaagcattccctcctggatgaaacataacaaaaaaggaggaaatggctgattctaacagacaaaaccaagcacttccctaaggttgtaacagaccatgccaaggagacacgattcctccatctcaccctcccctttaaggataaaatagaaaaatgcaaactcaatagaaaccaggaagcaaagggacctggagagaccatgcctaatggctcagttccgtgtcttttactccagtttccccagccttccctaatttgtacagtgttcaagagagccctaaggaactgaaagatctggaaccctttcttttgtattggctgaaactcagttcagaaagcagttaatgggtactattaaaataccaaataggttgggcatggtaactcatgcctgtaatcccaacactttgggaggccaaggtgggtggatcacttgagcccaggagtttaagaccagctcaggcaatgtagtgagactccgtctctacaaacaacaacaacaacaacaacaacaacaaaacattaaaaatcagcctgacatggtggtgcatgcctgtgatcccagatacttgggaggctgaggtgggaggatcacttgagcctgggaggtcgaggctgcagtgagccaagattgtgccactgcactccagcctgggtgacagagcaagaccctgtctcaaaaacgaaacaaaacaaaaagcaaataagaaagcagtcagtatatattctggagttatgaatattgggtggcaggcagagcaaatatgaatgtcctcatcatgggaagtagaagaaatatgtgggtggctggcctggctttcttgtttaactatctggaagaagaaagatcatactacagtatatttttttagcctctgctaaactttctcaggtcagctttgattcctagctcttcactcatagtggtaatattgagatatagatactggagaacagcaagaaacataaacataaaacagctccaagaaatgtcttgttagttttgccaacaagttaacttgtgagttaaaaggatataggagggaagaaaggctgcagatctgttgaacatttagcagtacagtcgacccttgaacaacacagggggattggggatgctaaccccctagagtcaaaaatccatttacaactcttgactaccctaaaacctaactaccaatagcctactgttgactggaagccttacagttgattaacatattttgtatgtcatatgcattacgtactgtattctttcaacaaagtatgctagagaaaagaatggtttttgttttgttttgttttgttttttgtttgtttttgagacggagtctccgtctgttgccaggctggagtgcagagctcagctcactgcaacctctacctcccgggttcaagtgattctcctaccttagcctcccgagtggctgggattacaggcatgtaccaccacgcccagctaatttttgtatttttagtagagatggggtttcaccatgttgaccaggctggtctcgatcgcttgacctcatgatccacccacctcggcctccgaaagtgctgggattacaggcgtgagccactgtgcctggccgaaaagaatgttattatgctaagaaaatcataaggaagagaaaatacgtttactattcattaatcaaaagtggatcatcacaaaggtcttcattctcattgtcttcatgttgactaggctgaggaggagtaagaggatgggttggtcttgctgtcttgggtggcagagatggacgaagaggtggaagggaagacaggagaggtggatacagttgtttgaaaaaaatctgcgtataagaggacccacgtagttcaagcttctgttgttcaagggtcatctgtactttattcattcaacaaatatttattgagcaactctctgttccaggcactaagctgagctggtttatctttgttgacctgtggaagagagggaccagcaagcaggcaactagcagccagtgtgaattgcactttgaggtgtacatctatagccagtgtgctgcactgctagcacacaaggggccacctcaccccgacttccacagttcctctgggtagccagcagaggaaatgatgtcgaaattgaaacctgaaggatgagtgtggataagcccggagaggatcctttagggatctagaagtagcccaataggcctggagagtgtatagtttatcccagtatgtttcacttgaactggattcattgatttccaggcttctacaatgtatcgttggttatctttaagtgagacattgtaccttttagtatcttttaagtaaaaatgggcttatttggtaatatgtttagttaatggctctaccatcaccattccctaccaaatctgggttagtaattgtaacgcctacaaaatctgtggcataaattgaacatttttgaaacctgccaaactgaaaggaaggagagtgagtggttgacagtccgaagggaatatgattccatgtgtggtttgagcaaatttacataacttctctgtatctcaggttgtcagtctgtaaaatgggacttaaaccctcattcattctctccttcataaaaaagttgtgggaataatatctggcacatgggaaagcacacttttttttttaagaaagacttggcaaatttgcctgagtcgtgtataaccattggcgcaccagtggggcaccattccccgataagatcaaagcacattgcagactttgtctatggcagtctgttttgaggctaagtagcaacttgaggtgggtaagaaaatgtgcattctagagacagcatgagttcaatgtacaggtaaggtattcaatgtacaggtaaggcagaaggaaggaagggcaaagaaacaattccagggccctggtttctgggatgacaggcttcccaacactcatgccaggactattttccacctcggttcactatgggttttttttctttttttttaatataatgaatttttaaaatgtgtgtttgttgcccagattattccagaaagagttgaagggaggaaaggtgtgcttggtgtgctggtgattctagcactctctccagcctgatttctagtttgtgtggtgcatccagacagctcacccaggtgcccaggctctttctggtatccagagccaacccatccagggcaggagggtgaagattaggaggggcaaaggttagcctggaggttgcaattaacaagaatcaaaatgggtttcaggattctcacacccagttgctaatttcagctggtcctgtagaggtgacacgtagtaggacaacatggttttgggggcagtgctggggtgctggtctctgcttttctagggtagaaaggaatcatacattgaaaatgcttaaatcgatggaatgattttatgttcctcatgcttccatctctttctggtctgcctgctcttcctgccagcccttcactgtgacagtcaccactcctagacctctgtctctaggcatctcccaggaaggagaagtggaaaggaaagagaaaagagctcagtctctggtgcccaagacattgtgcaaaaaaaaaaaaaagatggagtcgaaaactttggtttacacaaaaaattaggaagttattaaatactacaaaggttttatgaaagctcaggcctggtcttgattgttttcccccaacaaacaaagttagggtctaaaggggtcctgaaaaggaaaagtccctcccctggttataccaatgggtggtcttggagtgtgctgtttacactcatataatctttacagtcaggtattggatggcgaggtatctttcaatctactttctagtcaccgattgttcctatgcgtgcattatatagatgacagaactgaggtacagagaagacaaagtcacagagctgctcagtgggtagagccaggactcagactccagagtcatgctcctaaaaccatggtacactgcctcatggtttcactttaccgtggatgaggagcctgagactcagaatttacttgaccaatttattcagttcattattgacataacctcaaccaattttcaaacttcaagtctagcactatattgaatatatccaaagccgagaatcctaaattcggtgagaaaagtaatgtacagaaggaggtggtggtgcttagatataactaaggtaaacatgaaaacttgagcttagaaatggaaactccctgttggcctcctggccatcttccccatgctgtagaataaaaagagatcctttcatttgccttaggatttaggaaagaaagctctttcacttccgttctgtgttccaggaaatagaaggccagatggacggggcttattcttaacagctgttcagtaatcccttcccctctcagccatggcctgtgcagaggaggcacggcctcatttgtaccttctccagattctgtttatgggcccaccagtcagatctcagaggcttagaaaaatccttgaagacagaaattgaaaataaaccactggttccccacaaacagagatgatgacaaaacttcaaagcctgatgcaggggacagtctgatgagacatcaagagcacagtcaggatgcttagaaattcatgacctgtcactgtcctaaggagaagaaatgttcctgttcccatggcggaacacattggccatgtagggcttaaaatttttctctgactccctgggagtatggaggaagagagttatgggaatggtgttagggactgggggtgggagggtggatttaaatggacacacaaaaggcttgcctcccagtgcagtggaatctaaacaatctgaaatagctcaagctcaagagttggcatgtgcttctgagctgccacccactgaacagagcaaggcctgttacacttggagatcccgctccttaaagagaacttgagaagtgaggtggcagaggcttggtttcaaaccacctcgtttgacagtttgcttcagtgaatccagtttttcccttattaccaaaaccaaattacaggggagtttgtctttataacagttaatataactttcttcctttttgcttagaaaatctgggttttctgagattgggaaataatgctttattgcttcagaggaacatggataaaaaaggaagacacgacactcagtagtggattcgccttcgtagggcagagaactttgttaggtgcaggcttagaaccctgcacttagctgtgctgctttgctctggctccggggttcgttttcatgtgctttttcggtttttaagattcatttgtgctcctgtccatgaacaccatcatgctcagcttcttcttttcctattgttgacagagatgtgtgcacagacccaggccatgcagatactggtgcctctaacttcgtcagcccagaacacctcacctctggcccccagcacaggaaagcagcgtggtcaggaggggttaaacttcggctgaagcacaggtaagacgcacggaagttggtgctggcagttcggaaaaagaacccagtccaaaaagccactcagctgctgggagaggagtcgggggcaaggatggtcaggatacaggctgttgagagagaggtaagaggcagaacaaggaggcgagatagaagctcagagtttagaaggatactgatcttattaatggtagtttacgcacaaggttctaaagaactgtaaagttcctgggaggtcattccagggtcccacaaatagtttgattcaaatatcatttcaaaaatacatttataattatttgtaaaactacaatttaaaacatcaaaagtgatacacttatgttttataccttggaaatgatcagtgtgccaaattgtacagcaagactaattcatctttgaactaatcttcatttaaaatttctcggaggaatgtcccaagattccaacgtaagcctaacaaagatttgtagctacttacccatgtgggtcagattttgagagtgaatgaacctgagtgcttcccatgtgctaggtgtcctggctttgcacgggctatctcattaaattctcacaccagccctgtgaggtttgctcttgtagaatagcattcagctaggaggcagtggattcaaattcagcctctacaccaatgcctcagcatcagcacaacagtgcctacttcataggacaactgtaggattcaacgagatacggtattcaaagcactcagcacacagcccactcagaacaaaaaataaatgttaggtggtggtataatgctgtgtgaatataattatcctcatcattctcatcattatcacaaaagtctgtatgatatcatgaatggtagtatgatacggggagtaagatggggtttgtgcagtgtcagactacctaaaattcaagcctagattctgccacttaccatagaccctcagacttgttatagaagctctctctacttccaactgtaaaataagtttaataactgatccgcctcctagggatgctgaaaggactgaaagagccgatacatgtcaagcactagggctgtgcctactatgtcatgagtgcaacaaatgttatcatagtaaccaattatcttgatttcagtttgggaagttctttcatatagacatgtcgacttgcattataaataagtaggctgggctcagtggctcatgcctgtaagcccagagattcaagaccagcctgggcaaaatggcaaaaccctgtctctacaaaaaatataaaaattagctgggcatactggcacacacctgtggtcccaagtactctggaggctgaggtgggaggattgcttgaacctgggaggtcgaggctacagtgagccatgattgagtcactgcgctctagcctgggagacagagcttcaaacaaacaatataatttggatttatgcaaatccatattggtatctttagactatccatgttcaataatacacaaatatacataaaagaaataatgttatataataaaacaacacttgtattggggtgtttaaggttctttgttagatttcatttgaaaaaaaaaaaaagatttaaaagaagtttaaacataccaaaggtctagggaggccaactggctggtgtctgagagtcaggccaagaacagggtgagattcgccaagacctctgactcaagagatccagccagcaaggttgctcccagagacatcctaagaagcagaagctccgaggttatcactctttcctttagcctgctaggatctttaaaatatagagaatcaaaattttctctttaacaaggaggtgtccacagggcccgataggctaatctaatgtcagtgccaaagctcaaggccagaaagtagtagttagggagtttctgctccagcctggaaagaaaatgatcaagacctgaactaaatcaatggtgatgggacaagagatgagacagatttgagataaatttagggaggcagaataaatagcagatgagggtaggataaaggagagaaaaactaaagagtgactgctgagttgctggtatgaggcacttggggatatctgcagggccattaggacagggaaggcaggaatcacagaaactgactgggggttaagaatatcagcagtagaatcacatagacctgggtttgagctagaaacaattaaaatattttataaaacaatccctgaaagttgagtggaacaaacaaatgtatatctacttactatcttaaacataaataaatcatatttataacaagctgggattgtcctcatcagtgtggtcaaagctggccgatggcgctatgtctgtatggagaacataagcgacaagcaatttcctttgtaaaaagtcatgagctagatggtgcagacatcactcctgctcttggctggaatttttactcttcatacactaagaattttacatgtatgtgtcatatctctacaaatacagtcacgtattgcttaatgacagggatacattctgagcaatgtgtcattaagcgattttattgttgctgaacatactagagtgcacttacacaaacctagatggtgtgacctacacacctgggccatttggtgtagcctagactatggtgtagctcttagactatgaacctggacagcatgttgctgtactgaattctgtaggcaattgtcacacaatggtaaggatttgcttgtctaaacagacaaaaatacaatgtaaaagataaaaaggatacacctacatagggcactcaccatgaagggagcctgcaggaatggcagttgctctgggagagtcagcgagtgagtggtgagtgaacgtgaaggccggtactgtgcactgctttactgtacactgaggctacgccaaatttatttaaaattttttcttctataattaacgttagcttactgtaactttataaacttttaaacttttaaaaatatttgactcttttgtattaacacttagtttagaacacagacacattgtatagctatacaaatattttcttttttatatccttatcctaaaagctttttttcattgaatttttttttcttttaaacatttttgttaaaaactgagacacaaacacacactctagcctaggccaaacagagcaggatcatcaataccactggcttctacctttatgtcttgtccctctggaaggtctgcaggggcagtgcatggagctgagctctcctggataacactgccttattcaggaacacctcctgtagaacctgcctgaggctatttcacagttagcttctttttttaataagtgggaatacagaataaaataatgattaaaagtataatatagtaaatacataagccagtaacacacatttattataaagtattatgtactgtacatgattgtatgtactgtacttttagaggactggcaagtgcagtaggtttatgccagcatcaaaaccacgtgagtgatggctacagcttcaccaggcgataggaatttttcagctccattataatcttatggaaccaccgtcataatgtgcactccattgttggctgaaatgtcattatgtggcacatgactgtaaattgtaagccctatgttagtgtacctcctaattttcctgtcccccaagaagtctctctgcaacccaactgttactgatatgggactaacctaggaaatcagagtcattctcatctagttacgctcagatcctacatcctgtttgttttgctttttacttttttgttttgaaatcattgtagactcacagaaaagttgtaaaaatagtacagagatttcctgtatacctgtcacccagctttctctaatgttaacaccctttataaccgtagtacaaatatcaaaactaagaaatcagcactggtgtaatactattagctaacagacttaactttatataaactataaactttactcagatctcaccattctttcccattaatgtcctgtttctgttctaggatcccacattgtgttcccttagcctcctctgatctgtgatatttcctcagtctttccttggcttttgtgaccttgacacttttgaagagctctgggcagatattttgtagaatgcttactatttgggtgtgtctgatgtgttctcatggttacattgaggtgatggcttttgacaataccacagaagtgatgttgttttcttctgtctcatataagggttacatgatgtcaatatgtctcattactggtgatgattaaccttgattacttggttatggtgaagtccgccaggtttttctattttaaagttactatttgtccctttgtaattaataaataaccttggaaagataattttcaggctatggaaatatcctgtttctcctcaaactttcttcactgatcttggcatctatcagtgttgcctgtgacaactattactataatgttctaaatttgattctttatttctttcattttttctacatttattaattagaatttttaaaaaagcctatttctctcctctacttatttattcattattcattcatgtcagtaaggactcttccatatttattttatcctgtgggttataattcagtactactgttatttattttgttgttcaaatggatctagttttggccatcgagagctcttttgagctggctctggtctaagtcctgtttggaaatgtggaaaaggatgaggtagtgatgccttgtccttacacaaaagactgcagaccatgatgtgctatcatcttcttaggagtcttataaatgttgaagtgggaggttgatggtgggtatggagcagttctaatttgtgacatgtcacagaggcctatactgattttggaattggaaagtgctgtggtcacctcatgagctagttccaagtccatgagtaacaggtatatatatattcatagctccttcattgtggagaaaatagccaggaaggatcttctcacttatctataagaaaaaagaaaagccagaagctcatttcccaggtatatataggagccagtgaaacaaccaagttaaacagagagagacacttttagtggtccagggcttaatattctcacagatccaatcccacccttcctttcccgcttagatccctgcattctctcttatctatcaacaggaattcttatgatctaacttatcttggcagaaacttctctctaaaatctatcaagccttgggctagggtaatgagtcggtaaaggagacaaaatgttctagcttgaaactgaagattttccaagccgatgcttttctccataagcttctcattccttcctcaccttctcccacaagtcattataaaaatagtctgatgtaattattaagcatttacccttatatggggatctcggatcaccatgcttcataaagtaaatcaagatgaatggataatagaagctcagaatctgactcctctaattcattctcaattgaacagcaaggttagttctgcggtgctgtcccttggcagtgagttctgtccctgtgctgctgacttagtgttttcatgacagtacatcttaggaagatgcggtgagatgttgttatagaaccactgcttcagtcgactccctaactatgggaggcttaaagcaactagcacttttgtagacagtggcatttttgcatatggaggagggcatgtgtttagcagagaagatcatttaaggagacttcctgatttcagtttgatgcattctatcatcagatgattttccttgcttccctcctcctcttgcccacaaaaatagaattccagcatttctaagctataggctattgttcaagatgccagctcttctcagggagtcattaagggtcaccttctcttcttccctcttacagagcaggaattgaattttaattggccaatttacagaggggactggcattgagagtccctcccacttgcgctgagctgggcaagttcaaggcgattcaggccgtccaactggaggcacatgtagtacttgtgaggcttttaccatgctgtggggagcagaaagagcagtagcagggcagaatggctttttattccacgactgaatatgacatccaattggccagagggttgctatctgggatgtttctatttgccacaaggtaagttcagtattgtgttagaatgcgattcagaatctttcattgcaggatcctccaatgacaagcctttaacagctgtctttttgatattgtgctatatctgtttataaagaaaaataaccaactgcctgttaggtttaaacctgtttctctaaattgttatgaatattctcattatttgaatatctcacatgatttggtgtagtattaatatttctgttcgggaattctcattctcctatgtataaatacagtcgccctattttttatgatgtgtgtatcttgactggctttttatcccattcaaattaacaagtgctttgtgctgtgtacctcacggttttccttcctcatttccctggggaatttcagagtaaccattgctgtttcttatgggaatggttatatacctatgtactagtagccaagttctctattctcattgccaatatttgtataaagaaagggaagtttttattttatttgactttcacttattccttctctgatgcacttcctttttttacacagatctaagtttctgatctatatcattttccttttctctaaagaacttttaatatttcttgcaaggcaagtctattggcaacaaattccctcaatttttgtttacctgagaaagactttacttctttcaacacttttgaagaataatttcacaggatccagaatctatgttggtgttttttgtttgtttgtttttcctttcaacactttcaatcttttactccactctcttctttcttgcatggtttctgaggagaagtcagatgtaattctcatctttgctcccctataggtgaggtgtttttcccatctggcttctttcaggctgtttggctttatctttggttttctgtagtttgaaactgacatacctaggtgtagtttttctggtatttatcttgcttcatgttcttggagcttcctggatctgtggtttggtgtctgacattaatctggggagattctcagtcattattgtttcaagaatttcttttcttcctttccctctttcttttcattctggtatttccattacgtctatgttacaccttttgtagttgtctctcagttcttggatattctgttctggaattttctgtctttttttctccttgcctttcagttttgaaggttttttattcagatatcctcaggcacaaagattctttccttggccctgtccagcatgcatgtgtggggcaggggtatgggcaaggaaatctctgtaccttccactcagctttgatgtgaacctaaaactgctctaaaaaaatttttttaagtctattttttaaaaaaagaagacaaaaggaacccatgtgtatattctaaatttcaaagaaaaggtatagtcttcttattcaactttgagattatagtcatatatgaaaagaagtattgattgagattgccaattgtacattatttaactccatcacaattgaagatttaaatacttcattatattttctcttataattcaaattcaacttttatccatatataatcttgatttgaaattttcctccagaattatgctaaatgtcagcgcttgcttctatagatgcctttacttaaaataggacatggaaaaaaacaggtggatgcaacagtcgtggtaatgttctagctctctagctgatttgagtatttattttattattataggcattcattttattattacaccatgtaaaagataaaaaagacaacatgaactgcttatattatcaaatttgctcatctatatatagagagattacagggctggttttcccagttttatttggcattctttcatctgaaagtgagtaagagagaacgttcttttgatttttattctcccaaagtgtcagcttctgtttgagcagtggtagttaaactcttctctattgtaaaatttcttgtggaaatattggtaggtaggaattgagctggagcaagtgttaaagtcttttacattttcagctgctctgccttaaaaccttcactattctttttatttcagttccagtaacatttggaaactttattttaatgaagtttctttgccagtctgagttgaaaatatagattcttttgagcattatttaacatttttcactaaaattaatgccttctgtcttttcctttgttttcttattgcctctaatttcttacttatggccttttcctttaaatgaagaggaagacagtgaaatagagaagtgaaaaatataacacaaggcatcagacttactccaaaagagaattcagtttgtttggtgttagaggtttgggagggatttgcttttgtttaatggagtggtgtttagaataaataaccatcaaaaggtaaggcttctgcctcacacacacaaatgcaaaaaacacaaccctttcttcatttgttttgaggagtgcaatttaatttattcttggccttgtataaaaattagcttaattttgaaatatgttggttggtatttggactcctttaaactctcaaaggcaatcttttatgggtttctcattaaggaggaaggtttcctgcttaggggtagccttctccgggcactcagcctcaccatctgctggatagaggggagaagctctacaccttttactacaccctgctgagctgctcctcatttgtctgccagcagaagtcctctgggaaagctcccagacatcttctccctaaaaagctatagtaattcaggggcacacacaacatttctagccctctgcagctatctgagcctctctgagatccatgacagtcttgggggtgtttgcatgtgcctgtctgtggaaaataacacaccaccatggaagtgatttctcctaagttttagcaacatatgctatggcacagaaaaacagtatggaagaaaattctaaaatcatatctgatatctggagaaattggtagaaaccatccttctttcctccaacaaataaaatgcccagttccaaatgagagttgagaaacagaaattatttattggtaattagaagttgtgctattctatttatgctgtgctgttcttttgtaattgagtttgtaaattaataaaaggcaaagatgaatgctattacacatcatagatattacaatgtttgcatcaaattctgcttgatttttatgcagatgttgacatgtaggaaggacagttgaatattctgattctctgtgtgtgtcattgctgacaaaggggatataaagaggggaatattggggaaaaaaacatttcaatttgttaccccccggcaattgaatgaaaaacacccctgttgctagtccctctcttttatagtagtgttttcatgcagtaatcaataaaatttaatcttcaaaaactgtttcagaatggaggatggggaggagataactagtagtgaaggggatattgggacaggcatggtagaatggggtaaagtaggatacgagaaaaggggctgtatcttttatgccagttttggtgttacagcgttatgactgcacattagcagacttcacacttactgatgcttcagctgtcaaaaccaaaagtccccaggacatattatcaggatgtgacatttaaaaacaacttttctttccagaagggactgtgtgttgctatgagatggtattacctaatgcatacctttctacctactgaaccactttttaaagacacagatattaatgagggaattatgaaaagccttggaaaagtgttttttaggtttttttttttttttttttttttttttttgtgaatccaaaaggtctgagggatagtcttgaggagcctggaagtagttatagaaacaaggagttggccgggtgcagtggttcaggcctgtaatccctttgctaatggagtgttgaaggacaatggccaccttttttcgtgttttgaaagattcttgtttgtttcaaatcttttaaaaatgcttcagaccttttctgtctcctgtgaacatattataaacatctaaacaccatctgaatgaaacaatgttatgagtgcagctcagtgttttttgacttggtcccagttttccattgctatatgtttttatcattagtatttggggcctatcattttcctataaacagtaaatgcctaaaaagggatgttgttcaaatatgcatcatctattattctatactaaagaagatataatctctccctgaattctttctttttttttttttttttgaggcagagtctcgttctgttgcccaggctggagtgcagtggtgcaatctcagctcattgcaacctcgcctcccggagtcaagcgattctcctgcctcagccttctgagtagctaggattacaggcacgcaccaccacaccccgctaatttttgtatttttactagagacggggtttcaccatgttggtcaggctggtcttgaactcctgacctcgtggtccgcccacctcggcctcccaaagtgctgagattacaggcctgagtcaccacgcccggcctccccccgaattatttctacagtgacatttaattgttcatattgagtttatttcctttttaaaatgtgaaagggggcaatttagcagtaattatcaaaattggaagtgcatttaccctttgagccagcaactccacttttaagaatttctccagcactttgggaggccgaggcgggcggatcaagaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggtgacagagcgagactccgtctcaaaaaaaaaaaaagaatttctgcagacatttcaacatacatagaaaacactatgtggacatggttattcattgcagcattatttgtaatagcaaaagactagacatgaaaaagtgtctacaaaaggggtctggttaaacaaatatatgcatacggtggagtactaggtagctgaaaggaaataaaggtatgaggaagctctgtaaatactggtatagaatgatcttcaatatgtttgagggcttttatttgagaagggggtctcagttttgcccaggctgatcataaactcctgagctcaagcaattctaccacctcagactttcaagtagctgggactacaggcgtgagccaccatgcccagctgaatatgtattgttgagtaaaaaagcaagggatagaacaggccatgaagtttcttttgggaaaggagtgaaatgagattatatgttcatgtttgcctgtatttgcataacagaacactggaaaagatacttaagaaattaactacagtggttagcttgtaggggcaagagaaatgggtgtggtggaggaggaataccagaagtaaatatggggaaaatatgaagactttataaactttataaattttgatgatgcatacatggttatttatattaatccagatacatttatatatgtttaaaatgtttcataagcaaggcataggggtacgtgctatagtcctagctacttaggaggctgtgatgggaggattgtttgagcccaggagttcaaggctgcagtacgctatgatcatgccactgcactccagcttgggtgacagagtgagaccctgcctcaaaaaacgatttcataattttaaaaatacatgaggaaaaatggggaaaaacagcagtggcatgtaaaaagaatctttaaaaacaatgctttactattcacaatagcaaagacatggaatcatcctaaagggccatcaatgacagattggataaagaaaatgtgctacctatacaccatggaatactatgcagccgtaaaaaagaatgagataatgtcttttgcaggaacatggatggagctggaggccattatccttagcaaactaacgcaggaacagaagaccaaattctgcatgttctcataagtgggagctaaatgatgagaacacatggacatatggaagggaacaacacacactggggcctacttgagggtgaagggtaggaggagagagaagatcagaaaacataactattgggtactaggcttagtgcctgggtgatggaataatctatataacacccccagtccatgacacaagcttacctatataacaaacctgcatgtgtacccctaaaattaaagttaaaaaaaaaaccagtgctttatccccagctaagcacagtgttcaataagaatatgatgaagatctacaattcaaatatttgaaattttaatttaatagacctaatttgcagaatatattgatgtattttgtttcttttttgggggatatgggggtgtttgattagaactttcttatgatggactttgtctcatagtattgcgcactaaacaataatggatggagaggttgatgggttagtaaggggtttaagaaatatggtaacttttattttgtggtgctggtagtctgagtatattttgtattcttatacacttgactcgggtccagttgataactggcagagttttataacactgcaccgagaagagcccatgcaacatgtgtcataacagttcgttaaagaatagcatcaacaaaaaaattagttcttagaattttttattttccaactaatagttgtcactttctccatttatccaaagcataccaatctttcaaggtcatctgaagtcccactgtactactaagccttctggctgacttcagaccccattcatgtgagctttttgtatccaaaatgcctctacagcctcggtggcccaatatgatctgaattttataccatctgctcttcactcacaaggctctggctatactctcttgtattctttaaaaacccaaactcattcctcctctcaaggattttgcattcatttttcctttggagctatatattcttctcctagctctttgcatggttaattatttcttatcatttaggtcttggtttgaatgtcacttgctcatagaggctgtctctgacttaaatggggactttccatcacactctcacattacccagttttatttccttcagaacccttataactatatgagaatatcttgtttgatttgcttacttgcttactccctgtctccctcctctgcctctcccacctcattgcacagtgctccttacttgcaaattaaaagcacaggctctggagagagatgcctgggtttagtagctgtgctgctcactacatttgtgacagtgaacacattgtttattctgtatttacctcactttcctcattaatagtcctgtatcataaaggtaatataaaggctaagtgagaaaatactcgtcaagtgcctagaatggtggttggcactcagtaggcactcaaatattttttgagtgaatgaatgatgctctgactttgtttaatagtttttcttgcatctgagcctccccagcaagattataaactcttaggccttccaagaccttgcagagctccaactataatttaacaaggttgaaggcacataggtgattagtgaatactgcttaaaatactgaacttactgtagatttctcagaaacttgttttgcattcctgaatctctctgtgttagggcaaaatcatctaagaaggacatcatgtcacttgcgaattccagtttcatcagcctacccatcccacgcagttaagcttccttgtttgtggttaggaatgcaacaaaagggctttgtttgaattacacccacacacaaaacttagtttgctaaattttaaaattaaaccatcttctgacttactgatatgctcatgatgtgatgtactttaggaaaatatttctttaagttcttaaagatcaaagtgatcccaaaatgtaaaattagtatgccatgctctttaggaatgcttattaaatgtttcgcatcattgagaaagtcagctgtttaactgaaaaaatagctgtttaattttttttttttaactctcaagctacagtgaattgtattttcaaaatgaaagactattttaaaaatactttgcttttcaataggtaatacatgcgtatagtataaaatttgaaaagttacaaaatgaaatacagtgaaaataagttttccttcccagaggcagtcattgtatctagtttcttaagtgtccttccaaaactactctttacgttaatatacacacatgtgattttccccacatactgtagcagactgtacatgtaattctgcatctttccagtgtaacaatatatttggagatatttccatatcagtatgtatagagatacttcatcctttttaacagccattatatggatataccacactgagttaactagtctgctgctaatgggcatttaggttgtcttccaatcttttgatgggtatgttattttaaaaatcatttgctagatgttgtcaaactggccttcattcaggttgtactgatatacactggtgggctatttttggtcatccttttcaattcttcgcttatttcatcacttacctcctatctgtacggtatggaagaatcttataaaacaaagatttatctccgaagccctctcccaacatatcttctgcatctaaaagaaaagttgttttttgtttttttttcctcgtgtttttgtttttttcagggccttttgatttgcttccccctccccacccccaccgccaaaatcatcctgtcatcttgttcttaatctattagaactgtgatgaaacctgatactctgcccagggcaaataaatagttacctctccaacctcctccaaagtaaaagctccaaagttgagtttgctgtctttgtattgcaggtattggacctactttctaaagcacttattttatctgtactgtaggaattatttcatttgctctttcctgcagaatgtaagctccttaaaggcagagacaatatcttagtcattatttctttaaaatatctctttaaaatttgtttaattttttattttcttaaatggacatttaattgtacatatttatggggtacataatgatgtttcagtacaaataatgtatagtgatgagataaggataattaaatatttttaaatatcagtttcaactcttctagtcctcatgtaccacatccctggagcccgatcccgtgtgtcacctccctcacttctccctcttccaggttaggttcatcatgaaaacagaggacattgggtacgaggtcccctcaacttttcgtgctacctacttgctttcacatttgccagcatccacctttcttctatctcaacagcactggctttcctcctccataagctcatacccttcacctgagtgtttgaatcccatcccttcctgagtctttaaggagtcctcctcctgtgtcctgtgtcttcagatgggcctctgcacgctctctgccttatagacacttgcttgaacttctcatttaaaacaaaaacattaggaacaaaaccttttcactccctggatcccttcagtcttctagctaccaccctcttctcccctttagaaacaggtttttgaaggaatcatctgcccatactgcctgtcttatcccttgttcacctttagccccatcctaaagcatgccattgcaaggacttgctagttgccaaatccagtggccatgcatctaccctcatcacactaacctctttacagcattgcagtggttgacagtttcctcctcctcctcactctccccactagaaatctgtgagactcccatacttaacttgttttcctcctccttctgtggaagctcctcttgggctttttcccaggctccctctcccctaaattttgatcattctcagagactcatccttaaatcatttcctttgtctccctgttcattctcctcaagtcacttatcttctctcaaaggccctgtgttttgtgacttgtaaatttctatatgcagcccagccctcagtcctctagtccttctccactgaaagtcccacaggcactcattcgcatgccccagaatgagccatcagcatcctgcttatttcctcttctctctctccactcccatcccctccatctaaaaaaaaaaaaaaaaaaaaaatttaagagactgtctctctggaagctgcaatgcagtggcacacagtcattgctcgctacagcttcaaactcctgggttcaagtgattctcctgcttcagcctctgagtagtggggactacaggtggatgccaccacacccagctaattaaaaaaaaaattgagccccctgcctcagcctcccaagtaactcagcttataggcacaagcaaactagagggcctatctggaacccctgaagttatcagtaaacgttgtctcacacctcatctccttgacaggaagacatcttttttcctgtggagcctgtggaatttatcactttctatttctcttgggtgggaaaatcttctcggcatctagctaggcatggacagatactgttgggtgatgatgccactgaagagccgtccttagtgtcacgtggtgctggtctgaggtcacggtccattggtgtccattggcttctcaaggccaatacccagtcccggggctaatttctactactgagagtgattctgccaactcccttcactaagtagtgggaatgagcagtaggaagatgacagtttgttctttctcttctttctcctaatgtattttgggcccactggggtctaaaatgatacatacatgaaacacctctaggtatctcatgcaaaagagactttattttttctttgaggctgggcttttgctatgtgattaagcagtggcatttgttgagtacctgaagtcatatataactgggtttaaacccttactcccagacttactagctgtgtgatttgggccagcccctgaagggtttagagcactaggaaggatttctaatcattggatggaacaaggtgataaaccaggaatctaagtcagtgaggcagcctaccttcaaggaaccggttgaagatgcagcagcctaatttctggggactttggtgtccaaaattagagaaggactagcagcaagaatactgaactgctaagatgctgagccatgaaccctcaggctccctgcctacctgcactgagaaaaaggttgattcggccgggcacggtggctcacgcctgtaattccagcaccttgggaggccaaagtgggcagatcacaaggtcaggagttcaagaccagcctggccaatatggtgaaagcctgtctctactaaaaatacaaaaaattagccaggcatggtggcacagcctgtaatcccagctacttgggaggctgaggcaggagaactgcttgaacccaggaggtggaagttgcagtgagccaagattgtgccattgcactccagcctgggcgatagagcaagactccatctcaaaaaaaaaggttgattcaactttagaaggccaaggtgggcggatcacttgaggccaggagtttgagaccagcctggctgacatggtgaaaccccgtctctaccaaaaaaaaaagaaatgcaagaaaaataataattagccagtcatggtggcgtgtgcctgtagtcccagcctcctactcaggatgctgaggtacaagaatcacttgaacctgggaggcagaggttgcagtgagccaagattgcgccactgcactccaacctgggcagcagtgctgaacttcaaggtttagtggttacatgggacctgttattgaagattagagaggtatggtgatatggtttggctgtgtccccaacaaaatctcatctttaattcccacgtgttgtgggagggacccggtgggaggtaattgaatgatggaggcaagtctttcccatgctgttctcatgatagtgaataagtctcatgagatctaggttttaaaaagaggagttcccctgcaaatgctctctctctctttgcctgcttccatccatgtaagatgtgacttgctgctccttgccttctgccatgattgtgaggcctctccctaagccatgtggaagtgtgagtccattagacctctttcttttgtaaattgcccagtctcaggtatgtctttatcagcagcgtgagaatgaactaatacatgtggggacaaggaggcaaacaaattgtcatatgttggttctgctgttgatgtcttgattttgcatctacttcatctccttagcccaagctgtgcacctgctcccttttgttcctttatagtttccaggtgggtgaggtctgtttctttttggcctatgtttacccccgtgatttcaggtcacagccactgctctgatggctcccttcctcaccaccatggccagggtccgaaaggctgtgaccatggtaagtctcaggccaggctctgtcataattattgactcaatacctcactggggagctcggggcaatacctcactggggagctcggggctgggcgcctcatcagcaccagcagttcctgcccattcttgtctccctcatcatttaccatccttctttttaaagatctctgaaggcttgtctccctaccctgtctactattcatcaacttattagtaatgaatgatggtaataagacttaacatttattgagctcttactatgggccaggtgtgttttctcatttttaatctcacaaaactccgtcaataggttctactataatctgcccttcattgataaggaaactcagggtgattacgaaatttacctgagatctaaaagctaaaaccagtggtattcagtttaaatctggattagaacccaggtttttcttatctcagagctggtacccttagctacattccagcctctctccctctcttgagagggagttgaatttttctcacttttcctgacctatttggcaactcaagcattagtccacctgactacagactccttcaattcagtaaatctttgttgactgactgtttgaaaaaaaaaaatttgtgtatttgtttcccttgcttcacacaagaacattttcctatcaccctaatctctaaggagttgaagtatatgtttgtgttttgttttgtttttaagtcatcatctattttgggaagctcttcagtgtctgctatatttttaaagttattttagattaagatgcagttaatccagcctctgattaatcttctgactttctagatgagcaaaggcttagctaagaaggggaagtaactcacataaggtcagacagcaagttaataacgaagtcagggcaagagcccaggtctcctgacacctggtctagtatttttctgatgtcctaatacattaaattttattagcttcaggggaattatttttcatttatattacaaaaactaatttattttttcacagaaaagagataggtgcatttttagctacaaggccaagtacaatgagttggaataatttacagctattattttcaccatatccagatggattcctggatcccataaaagtgtttctaaactgcagaaaaatccccctacagtcttacagttcaagaattttcagcatgaaatgcctggtagattacctgactttttttgccaaaaataaggcacagcagctctctcctgactctgactttctatagtccttactgaattatagtccttactgaattcattcttcagtgttgcagtctgaaggacacccacattttctctttgtctttgtcaattctttgtgttgtaagggcaggatgtttaaaagttgaagtcattgacttgcaaaatgagaaatttcagagggcattttgttctctagaccatgtagcttagagcagtgttcacactgaggttgctgctaatgtttctgcagttcttaccaatagtatcatttacccagcaacaggatatgatagaggacttcgaaaaccccagaaaatgttttgccatatatccaaagccctttgggaaatggaaaggaattgcgggctcccatttttatatatggatagatagagaccaagaaagaccaaggcaactccatgtgctttacattaataaagtacaaaatgttaacatgtaggaagtctaggcgaagtttatgtgagaattctttacactaattttgcaacattttaatgcaagtctgaaattatgtcaaaataagtaaaaatttttacaagttaagcagagaataacaatgattagtcagagaaataagtagcaaaatcttcttctcagtattgacttggttgcttttcaatctctgaggacacagcagtcttcgcttccaaatccacaagtcacatcagtgaggagactcagctgagactttggctaatgttggggggtccctcctgtgtctccccaggcgcagtgagcctgcaggccgacctcactcgtggcacacaactaaatctggggagaagcaacccgatgccagcatgatgcagatatctcagggtatgatcggccctccttggcaccaaagctaccattccaggtaagtggctatagctgagactgaagggtttctttctttctaatgtcatgttcccagaaaagaatgttttcttctctgttttgagaatgttttttcttatactcacactaaatattaaatctctatccactgcttttctcatcctcttatagtgcttgacgtgtatatgagttacctttatatgcttggctagatcaacttgaagatcagaattatttgaagcactggctggccatttgagatatttatggggtccatcaattctcagacatttctccactgatagcactatattagaaaaattgagatttttcttccttcagtgcttaagtgtgctttctgccttagtcaaaaccgtatccatttttattcctgtgtttgaactccccatttggttttgctctttcaattaaggtaatttgtccatcttagctccaacggcacaactaatgtactgaggaccactcagtgtatacattatctcatgtagtgactcatagacttctttaaaacagatacagtagtattaaccccattttgcagaataggaaattgaagcttgcggctgggtgcagtggcttatgcctgtaatcccagcactttgggaggccaaggagggcggatcacctgaggtcaggagttcaagaccagcctggccaacacggtgaaaccctgtctctactaaaaatacaaaaattagccaggtgtggtggcatgaacctgtaatcccagctactcgggaggctgaggcagaagaatcgcttgaacccgggaggtggaggttgcagtgagctcagatcacgccactgcactccaacctgggtgacagagtaagacttcatctcaaaaaaaaaacaaacaaacaaacaaacagaaatttaagcttggaaagattagtttgtccaagctcaaacaactgatcagtacccaagtcaagacaaatccaagccaggtttcaaagctgctgcatgtaatcagtaggttatacttcctctgcttttctagctactgtttgttgtatgggtcaaggtttggtcaggaagaaggagagccctcacaagtggtttaggagaggggttatagaacgagggagcacagcctgaccaccatcacacattagagagagaactaagccaggactcccctccacttcagacttggaacccctacaaactggaatctatcttctgatcccagggagttagactccgtagcttatcacttttgggaaatgcttagatagcgctaatgtagcgaggtcaggaaaataagggtcacttagtccttacatacaaaggagacgcaagtgttggtatgtgtgtgcatgtgtgttggggggaggaggggaggctggaagcttctggaaggattacttaatgaacagatggtagctatgcatttggcaaggccagaactcagtcacagcccttaatactcatgtctggtcaagtcaagggccaaatcctagacctctcactgatgaacagtagctcatggaattgaacaggacaaacctctctcagcatatcagggtaggattcaggccacaggaagagataatgtcctggttccttcctggttacagatgctcctctcccttgcccatgtccttcccaatcaccctgaaagaaattattctcaccgtctgagccatctgttctcagagagcaggtttcctagcagtgtctcctgacccttgacaaagccagactacttttgctttacaggcatggaggtgttgagggcctttagaaggtaaggtgtgtggagcctaacaatgaaggaagaatagcatagtggtaagggactgggcctttaagtcagacctaggtttaaatctccccttacccctacggtgtaagcttgagcaaatcatttaacctttgatcttggcttccttttctgtaaaataactagtacctacatcattggattgttgtgaggattatataaaatagcatatgtgcaattcttagtacatagtaagcactcaatgaatgatgactgattataataattaagctgaagacttcaggacaccatgaaacctggtactgaacttgagggtgaatggccagcacacacttataaatgcaggtgggtatgtattaacagagtgcccttcaacagtggggtcctttgagcatccttactcctaaccttcttatgaagccctaaatccaaagccacactgtgacttaaaaaatgtgctggcccttcagcagagataagcactgcaatcagtacttagaatgactgcttacagtaactatggtgagctccagtaggcctcaggggaatggggccgtcagcaccagaagtacagtattttcaaggctttgcttctgcacctcctccttcctcctctgcatcccagcctccagaggggcttaggcaggtggatctgcccttgtgctgtatctaccactctgtctctctgattgaagcttcaaaattgttcctcctgacataaggaccatcagcacaaaagcactgcatggggacaaaaggagaaaggaaagttcaaataactcaaaatgttacaggcgtgtgcattctctcctgctgcagcacaaaccaccctgtggtgcagcacaaacaaaccatgcctgaggcttgcagctttggcagagggcttgacccccatgctgagttccacctgtgggatctgatcttggcagcggcaggtggagaggtgccccaggtgtgtttctgaggagcacagtggcatctagtggtccagtgtgccacatcagttggctggtatctctctgacagccttagtttaagttccagaaaccaatctcagtcctgaatttatggatctgtttcttgttaagaagcaggcgtaagagggggtgagaggatgagggagagacaggagtgaggtgagagagagagagaaagagaagtatggagagactgaagatgtgtaatttaactgtgagctaggttggatttggaatttcactgaaattgtatttcagctgctttctgtcagacccttgacactctgtttttgctgccctatggaaatctcacccagtggttctaaagtactaaagtactttagaagagactgaaaagttatgtagtctagccccctgacaagaggctgaaatagcagtatcaaatcagtgattcattcattcaacaaatctgtatgagcatccactatgtctcagatgctttgtaggtattgggagtacagtggtgaacaaggcataaaaagccccctgcaccacaattatttgtttcccaaaatgtgttccgtggaataacaatccactagatacttcttagaaaaaaaagtttctgagatcaagtaagtttagaaaacatctcttagttaaattatatatttctcttttagaacaacacatgaaaaatggtttgggagaacaatagtttataaaagactcagaaatcttgcagtaaataaaattgtttagcttatttagctcaatattttccaaacatatttaatcatctaaggaattagtgttctgtgagcacactttaggaaatgttttcatacacttattttgtgctctatgttttaaatattttaaaaatacttttttttttttttttgagatgggtctcactgtgttgcccaggctggggtgcagtgatgcgatcaaggctaactccaacattgacattctgggctcaagcgatcctcccgcctcagcctcccaaagtgctgggattacaggcgtgagccaccgtacctggtagatacctgtgtttaaaagtattttaaacacacaaaatagaatgatattataaaaatacatacatctaccacagaattaaaaagcattttatgttcacttcagttctttaaatattatagatacagtcaaagtctctttcacataaccaaagggatatgatataatgtcaagtagtggtaagtgctgtgaagaaaataaagcagggtaacaggcataaaggagagaagagatgctctttagttagttccaggaggtcctctctgaatgaagtaagagggagtaagccaggtgaagagcactccgggtggtgggagcagtgagtacaaagactctgagaccctgagatgggaataaatttcctgggtttgagtttcaacagggaaactattatgctggagtgcagggagcaagaagaagagcaatagaaaatgaggctggagaagtagccagaccatggtaagaactttgatccactcaagatgcacccctcttgagagtaaggctggctttatgtgagttggaattgttgcaggattgaaaaccttcattccaagttttcttacccatcattaaaagtgccattttggtggcatcaatggcaaaggtaataaaaatgagtatttccagacagcagtggaagaacttgtcctagtgagtgatatcagtgcctgtattccccaggcagcttgggaatggtaattctgaagggacagaaccctctccgggcaggagggaaaatacctaacagaggccttccatgacctttctaccttaggtttgctacaggaaggaacccactatacccttgcactggtctgattagagatatgtgtaacagggatttcatatttatagataccatctatattttaagatatgttaggctgggcacggtggctcacgcctgtaatcccagcactttgggaggccaaggagggtggatcatttgaggtcaggagtttgagacgtgcctggccaacatggtgaaaccccgtctctactaaaaatacaaaaattagctgggcatggtggtacctgcctgtaatcccagctactcgggaggctgaggcaggagaattgcttgaacccgggaggcggtggttgcagtgagccgagattgcgccactgcactccgtcctgggcgacagaccgagactctatcttaaaaaaaaaaaaaaaaaaaaaaaaaaaaaatatatatatatatatatatatatatatatatatattttagtgatggtatcttccccactcgatagtgtttcagttaaccatcagtttatttactttgatttgttgtgtgtgttcctatgttagatttgaattatcctttcaatgaaagactgctaaaattctcagcagttgggaggaggattacctaatgtctcctaccttcatagaaatggtgaatgaaacggcccttatggggttccatttcccctggaagtattagctctaaaaaggaagcagactgggtcatacaggattatccacaaggctgtctagcgcttctttagtaggacctctttatttagaggggaatgaagaaattcagggtagggggtaaaatctttgacatatgctatgccattgagtgccgggtctgatttccctgatctggctggcttgggagctatttccttcctttctcccttgaatttatacctatctgtcccgaagtaggatgcgccattcagtcaactgactttctctgatagagaaaaattacattcttgaggagagctgctgaaagtgtagtctccttttccttaaattccagcacaagttttgactccgaatatggtttttctagtctcaacatattatctggagatattccagccataaagcattatcacatacttgaccaataagacactacatttatttacatgtaatctagaaatagaagaatacatcatgaattttaatagtgttgaaacgcctatccatttaaaaatagaaaatcttgggcaagaacttctagtgatttacccttctttagagaacagtgagtcacaaacatttaaaccacttattccttcatatatgccctccccgtgtgtgtatatatatagagacagagacagacattttttagagcagttttagtttcatagtgaaattgaacaaagtccagagatttcccatatagtccctgtccccatacatgcacagcctcctccattttcagcaacccccaccagagtagtacatttgttacaactgataaacctacattgacacatcataatcacccaaagtccatagtttatattagggttcactgttgctgttgtgcattttgtaggtttggacaaatgtataatgacatgtatccatcattatagtatcgtacagaatactttcactgtcctaaaaatcctctgtgctcgcccattcctccttgcatcgcccctaagacctggcaaccactgatctttttattgtgtccattgttctgccttttccagaatgtcagtcatgtagttggaatcatatggtttgtagccttttcagactggcttttttcatctagtgaaatgcattttagtttctttcatatttttttcatggcttgacagctcttttttttttttttaagtaatgaataacattccattgtgtagatataccacagtttattcacctactgcagaacagccttgttgcttccatgttttggcaattatgaataaaactgctgtaaacatccgtgtgtgggtttttgtgtggacgtgagttttcagttccagtggataaatgccagggaatgtgatcactggatcttatggtaagagtatgtttaattttgtaagaaactgccaaacttcttttaaaagtggctgtgccattttgcattaccacctgcaatgaatgagagtttctcttgctccccatcctcaccagcatttggtattgtcaatgttctggattttggccgttctaataggtgtgtagtggtatcttggttttgtttggttgttttttgtttttgcctatgacagagccctcaggacgtcctgagaacatgttccctagtatcttgttgttttaatttgtaatttcctagtgacttatgatgacagccttttcatttgctttttcaccatctgtatatcttcttaggattggccagtttttaaatcaggttgttttcttattgttgagttttaagtgattttttaaaaacacatatattttgagtttctaagtaattttattttgagacagctttctggagtttacagtgattgatagtctttttcctcttctccagacgggctctgaaaaccatctggaggagcttgtaaatgagaaaatcttgccctcctaaatgtatgaggaggctttgctttggcttttggaagtcatccacaggtgttggaatcccagcaccgaagagcccctgtgattaagccttctcataaagcttccctctccttccctctttccccttagttctgcctctcatgagctttttctgactctaatttctctcattcagctttgtgtttagctttcccaccacaaacaaattgtttctagtgcagttaagattccaggaagattgccagggtgtatccttcaattccataaaaaggaaagatattaactaaaaacatatacatgtgcacacaaagtctccttcacccgtgcctattctcttattaactttttcccctcttcccacaaacagccccagtagacacacagtttcagtctcaatcactcttctacctctctcatttcttggcacatgcaaaatgtcatttccagcatgcagcaaatcacatcaaagtgctgcctgtgcccaaaggccacgtggcttcctctgagctcctcattcctctccttgctagcctgggtgattaattagaggcagataggttagagtgttgggcagttactcctagcgatgacacagaaggaggctgagcaaggcccaaatatggccctttttacccacccttccaaacaccaaacctcttgcacaagagaacatttataagctgggtcctctgcctgtaagcctactaaatgataacagctcagtggtactgactgctttgtctttcttccagctcctctactagtgacctctccaactatgaccatgcttatctaaggcggagccctgaccagtgcagctcccaggggagcatggagagcctggagcccagtggggcatacccaccctgtcatctttcccctgccaagtccaccggcagcattgaccagctcagccacttccataacaagagagactcggcttacagctctttctccaccagttctagcatcctagagtatccacaccctggcatctctggccgggagcgttcaggctccatggacaatacttctgctcgaggtggcctcctcgaagggatgaggcaggcagatattcgctatgtcaagacagtctatgacacccggaggggagtctcagcagagtatgaggtgaactcttcagccctgctgcttcaaggtagggaggcccgagcctcagcaaatggtcagggctatgataaatggtctaatattcctcggggcaagggagtgccacccccatcctggagccagcagtgccccagttccttggagactgccacggacaaccttcctcctaaggtgggtgcacccctgcctccagctcggagtgacagttacgcagcatttcggcaccgtgagcggcccagctcctggtctagccttgatcagaaacggctctgccggcctcaggcaaactctttaggctccctgaagtctccattcatagaggagcagctgcatactgtgctggagaagagtccagagaacagccccccagtgaagcccaagcataactatacccagaaggcccaacctggccaacctctgctgccgaccagcatctacccggtaccttccctggagccacactttgcccaggtgcctcagccttctgtgagtagcaacggtatgctctaccctgcactggccaaggagagtggatacatagcccctcagggagcatgcaacaagatggctaccattgatgagaatgggaaccagaatggatctggcaggcctgggtttgccttctgccagcccttagaacatgacttgctgtccccagtggagaagaaaccagaagctacagccaagtatgtcccctccaaagtccatttctgttcagtgcctgaaaatgaggaggatgcctccctgaagagacatctcacacctccccaaggcaacagcccacattccaatgagagaaagagcacccacagtaacaaaccatcttctcatccccacagcctcaaatgccctcaggctcaggcctggcaagcgggtgaagacaagagatcttccaggctctcagagccctgggagggcgatttccaggaagaccacaatgccaacctctggaggaggctggagagagaaggcctaggccagagcctgtcaggcaactttggcaagaccaagtcagccttctcatctctccagaacattcctgagagtctgagaagacacagcagcctggagctaggccggggaacccaggagggttaccccgggggcaggcccacctgtgcagtcaacaccaaggcagaagaccctgggaggaaagccgctcctgacctcgggagccatctggaccggcaggtttcctacccgcggcccgaggggaggaccggtgcctcggcttctttcaacagcacagacccaagtcccgaagagccgcctgccccctcgcacccgcacacatccagtctgggccggagggggcccggcccaggcagcgcctcggctcttcagggctttcagtacgggaagccccactgctcggtgctggagaaggtctccaaattcgagcagcgagagcaagggagccagagaccgagtgtgggcggctctggttttggccataactataggccccacaggaccgtctcaacttccagtacttctgggaatgacttcgaggagacaaaagcacacattcgtttctctgagtcagctgaacccctaggcaacggggagcagcacttcaaaaacggggagctgaagttggaagaggcttcccggcagccctgcggtcagcagctgagcggaggagcgtcggacagcggccgtggcccccagaggccggacgctcggctcctccgtagccagagcaccttccagctctccagcgagccagagagggagcccgagtggcgggacaggcccggctcgcccgaatcgcccctgctggatgcccccttcagccgcgcctaccggaacagcatcaaggacgcacagtcccgtgtcttgggggccacctcctttcgacgtcgagacctggagctgggggcgcccgtggcgtcgaggtcctggcggccacggccttcctcggcccacgtggggctgcggagccccgaggcgtcggcctccgcctccccgcacacgccccgggagcggcacagcgtgacccctgctgagggcgacctggccaggcccgtgccccctgccgcccggagaggtgctcgccggcgcctgactcccgagcagaagaagcgctcctactcggagcccgagaagatgaacgaggtggggatcgtggaggaggccgaaccggcacccctgggcccgcagagaaatgggatgcgtttcccggagagcagcgtggccgaccggcgccgtctcttcgagcgcgatggcaaggcctgctccacgctcagcctgtcggggcccgagctgaagcagttccagcagagcgccctggcggactacatccagcgcaagaccggcaagcggcctacctccgccgccggctgcagcctccaggagcccgggccactgcgtgagcgcgcccagagtgcctacctccagcccggccccgcggcgctcgaaggctccggcctcgcctcggcctccagcttgagctcactgcgggagcccagcctgcagccccgcagggaggccacgctcctgccggccacagttgcagaaacccagcaggctccccgagatcgcagcagctccttcgccggtggccgccgcctcggggaacggcgacgcggggacctgcttagcggagcaaacggtggaacaaggggcacccagagaggggatgagacccccagggagccatcctcctggggggccagggccgggaagtccatgtcggccgaggacctgctggaacgctcggacgtccttgcgggccctgtccatgtgaggtccaggtcatctcccgccaccgcagacaagcgccaggtacgtgcaaccagcaagtcctggcctcgaactgtcccttcctccctagaagctttagtggggctccccaaccccccacactctcacccgctctcccagttcagttttccttgtgattacagaaaagtagcatttgttttcatgagttgagtttctcaagtgtcccttacctggtttccttataaagatataggtatctagattacgtatgttgttatacagattctctatctatctgtctacctccattttaggaagtcaccacctctcaatggaaaaatgcaaggttaagaaaaattagggattatcttttttgttttttgcttttttttttttaatggattagagtctgggtctgagtattttaaaagttttagctttgcaccctttctgtttctattggactttgcatctacaaaatagctagaatgattgacattgatagtcattggttattgaattcctggccctcagctaagtgtgtggcaggtcctgagctaagtgtaatctacatttattatttcatttaaccctcatgataatcctgtgcagcagagtatattatacatgtcagacccctgtctctcggactcccacctcagctctttctgtgcattatcctggtgaggagagaaaataagaaactcaaaatctcacataaaaggattttctaataaaggcaccaaatgctgcaaggattataaagtactttcccctgaaaattttaagcagtgctgggaatagaagctgagcattctgactcctaggagcctgttaatttccctaattcttagcctatcctcaggcttcacttccactgtagaccaggggcctgcctcatgcttcccttcccaccaaagacaataataggaatcacatacctgttagcacaggggaggaagaactccgctccactctcccctctcagattctgctgttttccctttcagagaagtcagccattcagcaagcatctgtagagcatgtgttgtatgaaaaatgctgtgttacagcatcaaaggatacacaaaaggaaaaaataaggctcatgcctttctggagttcacagttaagcaaggaatacgaccttatatgtataaatctaatatgactagtgaatgctttgggaatagtgatcaataatatgctatggaaaggaaagtgattaattctgaggtgatctgaaagtgcttctcctgaagggaaatgggattttgggccaggatgtaaaagatgggcatgatgacaagagattaggggagaggggatgcattgatgggaagaaaccagttcagacaaagaaagattcagcagttctggctgagaagtttgctgcactctatcacacgcatacagcaacaaatgctacttgctcttaccagtcagatgcttatagggcaggattttacaagtttttgacaaggatttagctctttttcaaaattctcattagggaggcctttctgcctccaaaaacaaagtcatcatggaaatcagttcctctgtatgtgacgattgatccatctctggcctgaaataatgactgcaggaggctaccattttgaactacttgtagcctgagaccttctcatatatttggcaggtctggcctcttcctcagccagcttgaaatcctctctgaaacatgcaaccttctattttcttctcctttaattcctcttcattgcagaacaatagatactagtgatggagcttaagtgcacatcagactcttgcctgtttccttctgagagaaaataccgtcccctcccagatgttttctgtttagaattgtacagaaatattttctcccagtataaatccccgacaaatatagaggcaacttcccataagccttcagtagccttttccttccttcagaatgaacagagctaattcccactccctatcctaccactaacacacatttaaaatccatatatgtaacacacaatttcatttagcttgatggattttagcaacttaactgcatagcagtctagacaccttcctttctctccccgtgtttcaaagaaaataaaaatgcttaggtgaaaaccaaatcattattgtttattccccattagatattgttattttgtcttagaggttggttggatggctatgaatgttattttatctttccccccaaatatttcttaagcctggttgattaagaaataaagctaaaacataggcgttgggagaagtgaagagattcctccaaatcccaattaaatactttgtattatttggaaaactttttagaaagacaagtgaatacaaaacagtacttgggcacccttttcataaagggaatgccatatttagatgttatttaatttggggaatatgcaggcagagagggaaatatttccaaatgaaatacttcttttgtactgctttgctccaacaaatactgaaatttctgaacaatgcatagtctcttatattgtcactgtgccaggactgcattcttgagcttcctccctctcctggtctcctgcacagcagccagaccttagctgactggagaagcatctcatggcaaggcggtctgctccttgcatcctcttcatcatctgccttatttgtagttatgatgagtaaaaaataaaacaaagttactctcaccacataactattgtggttattatatacatatttttcctattgaataaatttcaagaacattatcagtaagcttttgggaaggtttgttaatcaatcatttttctcatccttgctttagagaattctgacaagttaagtgaacttgtagagactgtctgcctgagttaaaaccacaatgtggagtgtgtttctgctgctggcttagttgatgctatctccaacaaatgttgcttgctcttaccagtcagatgctgacagggcaggattttacaagtttttgacaaggatttagctctttttcaaaattctcattagtgaggcctttctgcctccaaaaacaaagtcatcatggaaatcagttcctctgtatgtgacaatcgatccatctctggcctgaaataatgactgcaggaggctaccattttgaactacttgtagcctgagaccttctcatgtatttggcaggtctggcctctcctcagccagcttgaaatcctctctgaaacatgcaaccttctattttcctctcctttaattcctcttcattgcagaacaaatagatattagtgatggagcttaagtgcacatcagactcttgcctgtttccactttctttctgtgagaccttggaaaagttaacctgttaaaagtgggtaggacctgcaaagctatagaaagatagccaacatttctgccttagagacagaaatgtatatctgttcattgcatagatttaaaatatagtagagactataaagagaaacccttggagaaataagattactggtggggatatttcccccggatgctgagttagagacttctctggttctcacagtattttcagggaacttcatgtctgatgtgtaacataatcactatgagatggtgtgacaaacattactgaattgctgaggaaattgctcaatgcatggaaccacagtattggatataggcttgattctgtggaatgcaactcataagtcttttttagcacctttctacaagcacacatttaagcttatacaaaatagaattgactttccacaaaatgtgaagatacaaatagctaacaataatcaaatttttgctgtgtgccagtcattgtactgtgttttataagtataaaattagtcttggctgggtgcagtggtgcacacctgtaatcccagcaccttgggaggccgaggtggctagattgcttgaggccaggagttcgagatcagcctggccaacatggcaaaaacccatctctactaaaaatacaaaaattagctaggcatggtggtgtgcatctgtagtcccagctacttgggagactgaggcacgagaatcgcttgaactcacgaggcagaggttgcagtgagctgagatagcgccacttccctccagcctgggcaacagagcaagactctgtctcaaaaaataaaataaaataaaattattcctcacatctgtgcaatgaggtaaatactattattatctctaagttacagaagaaggaaccaagtcaccaagagggtacaaaatttgcccaaggtagtagagtgaggttttcaccccatactgtctgactgcagagtctttaagtcactataccatgccatctcctgaataaaaagaggctgggaatggggaaacagaggcaagagttaaatgttctatatctgaaaatatcatccaatgaatttatttcattttaacatttattactatttcagtcatgcatcatataatggtcaaggatggaccacatatgtgacagtggtcccataagattataataccatacttttactgtatcttctccatgtttagatacaaaaatacataccattgtattgcaactgcctacagtattcagcacagtaatatgctgtaacaggtttgtagcctaggagcaataggcctataccatatagcctagggatgtagtagtctatgtcatctagtttctgtaagcacactctataatgtttgcacaaggacaaaattgcctaatgatgcatttctcagaacatatccctgttgttaagtgacacatgactgtatttttcacatcagatttttcataaggatttctagttatttttagtagttacttgaaatattctaaagtaggtgaatattgtcttcacatttcatcagtgacagagatattgagataactaacttggaacccaaaacaggaggactgagattcagtagactttagatttacattattattattattattattattattattattattattattattattattttgagacggagtctcgctcagtcacccaggctggagtgcactggcgcaatgtcggctcactgcaagctttgcctcccgggttcacgccattctcctgcctcagcctcctgagtagctcggactacaggcgcccgccaccaggccccggtaattttttttgtacttttggtagagacggggtttcaccacgttagccaggatgatctcgatctcctgacctcatgatctgcctgtctctgcctcccaaagtgctgggatcacaggcgtgagccaccgcgcccgaccaatttacattattaagtatgctaagaactggtgtatttttaagtcaattttgagataattaacaaaaataaatcagacacttaacaagttggtataattctatgcctagtatttttcccatagccactgtttttttttccctgtaattgccataataagcactttgtacttcttaccaatttatagaaaattaagtcttgacagtgaatatatgctcaaagcaagaaatgcaataggaatttatcttccttgggcttgtatcagattgggaagatattttcctttgtcaagtggtattttgattgatagaagattcagagaattctctcaatagtttattactgggtctaattcctttattttatccacatccacataaatagtttaagctcgatattctaggggccaaatcatgtgaatacagaagttatattcattgtcaaaacgaaatgcaaaggatgtaataggatatgaatacatatttatactttactgggttaggcgctcacatgggacctaggcttttccaattaattattggcaaagtagcacattcttgtcaacatagggaaaaatggtgggaaaagacttttaaaggaccataaatttcatggagagcaggaattctcattccctacagtgatatttgagtgaatcagaacacatggaattcatttttctcaagccattcaagtctgattacatccagcccagctgccattcaacctataaagattccatggcaagaccttgggctttgaagagatcatggcttgaatcatagtttctccacttacttaactgtgggcaagatatgtcaccttgctgagctgcaattacataccctgcttccaattgttataaagattaagttacaaaaaaaaagtcaagtgcctaatattccaggcatataatttgttggtgcaaggtacttagcagagtgtctggcacacagtaaatacccagtaccggtagctgcaattattaataatgttcaggggtttgtttcttctgcctgctcccacctttgaccctttctattgcttattagtttctcaaccactaaacaaaaacaatgaggaacggggtgaagagcagttaacccattgggcagggttaaatggcaaaataaattactgaaattaagttagagattatatatggatttaatttttctggtttttgcctgtctcctgtcataaataattgggagtttaatatattatcatcaatggcaacatcatcatcttcatcatggacctgatcacagggaccaaactgtatactatcaaaaactgacaaccctttcaggactccagtatataccctcattaaaacaaaaacaactacccctgaaaaggccccagagttattgatctcacatgtgagtgaactttttcctagaatttattgcacccgattacaatccaaattcatatcttcactaattgtaactaggaacatttgagatttttgcaaaatgtaatagactgtcctttcccgtcatctctcatatttccctattgccatttgaaaagtttggcccattgaattcattgtcttcgttatcctatttcaagtttagcagttgttttgaactccagagataatcgttaggagacttctcttagttaggaaacatccttgttagaggaggcacctggtgagacagactgaagttcaaattctgactctgctttttttttttttttttttttttaaatcttcggcttatctcctgcatcgatgccatgggattatgtaagagtgccaccacgtggcctgacaatagtaggttgccagtaaataggtgttccttctcctttttacctccaccctcttggtaaatttaaacacccgtttattggcagtaatgctgtgcctttcttgtgtttcaaggatgtgcttttggggcaagacagtggctttggtcttgtgaaggatccatgttatttggctggtcctggatctaggtatgtacatgtacttatgatgctctctgcatatgaatgctgctggtgttaaactactcttgttcctttctacaagaaattgaaatgtgatgtcatatagtgtcacatgcttttttgatttgtctaggccatggataacttttttttttagttttattattatactttaagttttagggtacatgtgcacaacgtgcaggtttgttacatatgtatacatgtgccatgttggtgtgctgcacccattaactcgtcatttagcatggagaactttttattttccatttagaaatgattttctttaagaatgacacttgttcaaaataggttttgaacatgtgctactgaggacaaggttgatttggctaaccagtttgacaacagaataattaatggaggtgctattcttgagcgtgccccatggctttcacaaatggggcctcctgtgtggctgatctcatccagctctgtgtgcagagcatcacatctggtgaccacagtgctagggaagaacgggcatttcatgaacagcttcacagaggaaggcaaactgtaagcatcggaggtgaaaaataaagctcaaaatcataactttatacatgtggggatggaaaacagaggaaagtcgtttttttaaaatgccatcaaaatcatatatcctgggtagaaaagtaaaatgagcacttttttagaatttaaaattttgaactgttcacatgggacttaataagtagaaattttcagaaagggtattctctgaaccatgtactctgtatgtagttttaatgcagcattacagagttatctactataatctattattactaatgataatacacctacaccctacctactcctttctacgtttttaagccatttccttaatttttcttacatttcattcaatcattgtttctacattcaccttcttaataacacaacctaattctgtcaagtagaagcagccaacatggtcaggaagtaggtattaattacctgctttctagccaagatcagccttctacatttatatgctcttgctcctatagctgtgttgacaaggaagaaagtattcaaggtgaggttgaggactttggtgagtttgggtgcattaattaaatgctagagacaagggaaaactaacaataaactagagtactgctaaagaaaattggtctgaaatcaaagacgggacgaaacaacaaacaatcaaataaccctatttaaaaatgggcaaaggtaaaaaaaagaacaagatcatgtcctttgcagcaacatggatggagctgaaggccattatcctaagcaaatgaacacagaaacaaaaaaacaaatactgcacgttctcacttacaagtggaagctaagcattaagtacacatggacacaaagaagggaacaatagacactggtgcctatttgagggtggagggtgggaggaaggtgaggattgaaaaaactacctatcaggtactatgcttacctgggtgacaaaattatctttacatcaaaccccagcgtcatgcaatttacccatgtaacaaacctgtacatgtactccttgaacctaaaataaaacttggaaaggaaaaaaataattgaaggtgacaggtgaggggggctgttggttggctcagtggcaatatcgacaatctgagaaacacaggtggcaattttgtggggagggggaaatcttcctcaacaaaattagttctgtgtttaaaaaaaaaaaaaaactttctgagctgtaaaaatgccaaaagaataaatatgacaagcatcgcataccactgaataactgaaatgcttgtcctgttcttcagcaattgacattagcataggtgcagctgcatgcctagtgcttgctgaaaaggatattgataatttcaggacatgtaattctcagctgtcctggggaaaagcataggcatggaaagtgcagccgacaggaaaacatgggagggacttgatcacagatcctgtgctatgaattttgagtactaaaaattctgcttgcagtatatttttctgaccatcacaaccaagaagacacaaaaaagtataacactcttttttttctaaaggcttgcatggtcttttatcatagtcactctgttaatcatagtacgaagacaagagtcacatcaactggacaatattgaaatgtcaaaataatttggaaggtggaatttggaggaatgtgccctctgttctccatgaatgcctattaggatcagtcagttttcctccatgctgacataattctccctgaatacatgaaattcagactttacattagtgctttttaaaaaacataaaatgttctaatttatagaaaagtagagattttgcactgttcaagttttatgagagtttgatgccttcatgggtcacaaagagacaatagttgtcattattatatacttctttcctgttttcaaacattctccactctttttatctccattttaaagaaaaacactagaggataccaatccaactaaattcagacattcacttgttaatttcaaacataaaaatttacttgtctatataaaaatgggcaaaagacttagacatttatccaaagatggcagacacatggccaacaagcattgaaaagatgctcaacaccactaatcatcagagaactcaaaaccacaatgagatgtttacctcacacacattagaatggctgcaattaaaaaaacgaaaaacaaccagtgttggtgaggatatggggaaattagaaaccttgcacactgttagtgggaatgtaaaatggtgcagccgtatgaaaaacagcatggagatctcagaacattaaaaatagaactaccatatgatctggcaatgccacttcagagtatgtgtccaaaaaaattgaaagcagggtctccaagacccatgttcacacccatgttcatagcagctgtatttactattcacaatagccaagaggtggaaacaacccaaatgtctactcatgacagatgattggataaacaaaatgtggtatagccatacaatggaatattactcagccttaaaaaggaaattctgccacatgcttcaacatgacattacgtgaagtgaaatataagccagtcacaaaaagacatactgtataatttcacttgtatgaagtacttaaagtagtcaaattcacacaaaacacaaaatagtgatttccaggggttagtaggagggggaaatggggagttattatttagtgggtacatagttttaggtttgcaagttgtgaaagttctggagatctgtttcacaacagtgtgaacatattaacactactgaacttaaaaatggttaagatgaaattttatgttgttttttctaaccacaattttttaaaaatgctttttctttttttttttaaagcaaaacaaaacaaaggtgagactaattgctctcaaaatccattcttgaatagtaggattcctggatacatatcagcagactctgggtgaccctctcacactctattataaaagggacttgaacaaagtctttttttatcccaaacttcattcctaaaaacacaaaataatcaccacggagaagcattctcaaccaagctaagcatttaccactgatattatcttcaaaaagaaaatgccactttagtatagtttgtgtaaactaaggtcacacaaactaaaaacatcatataaaagtctattgggctggatctttaaaggataagtgctatattattgtatgttttagtgatgtcttcccctttagaaaagcctcaagatataataaataaaataaaggcatctgaattagtcgttaaaacatcagatttcaactgactccacatcctgttaaaggatgctgggtttaaaaacagtttgtatgctacagtctggagagcagctgggcaaaggagacgtcactgttcaacagacatttgctgagggggtacttggtggcaggtactggggatgccaggatggatgagacagaagtgaagagcatccccagcgggaagccaccaggaagtgcagagtggctacacttctctatggagaggttcctggtaaagaaaccatgtctgaatgaaagggactggtcatgggaagggaggggttgcatcagagagagaggtgggccctttattccatcatctgcatctatgtataataaaggaaaaataaaggcatgagaagagctaatttggttctttgccatcttcttccaccacatgctgcattctgtttgcctggcacttggatgatcttgtggcaagccctgtgttattgctctgatgtgggactgagtcaccactccctcagaggagtcagatctgtgagatgaaatgtgccatctgcactccagatccactcacatagccagtcagggaactgcagacagggaatgtacaaatcacggtgggtttgctggagagctttttatcctcacattaactcttgcatagcaggtagtgccacagactcttttttctgttttgttttgtggatttttctcctttagaacacaataacaaaagttttgcgaattgttgggtttttcctcggagtctagcgtacagttgtttaaatcaccatgtactatatttgcttattattgccagcctctttctccagaggtaactgcttattagctccttaggtgagactctccccctcctttttatttttcatcagatgaaatgaaaacactaggagagtaagcaaaagttgtaaataaaaccttcaaattcagcagcccatgcaaatgctttcaaaacagacctcccccgtggggatcgcactgggagagaagaaggcagcattatttttccccagagctgggagctatttcctgaagtagtcctaaaaggggctgaagaaatgtactgtttgtttttatagcctgaagcctgtcctcaaaagctgccttatgttgcatggtgtgtacaggatgtgggggcggtgagagggttaataaaagaaaatgccttgtgaacccagtcattccatgtgacattttcctgtaggaatttatgcctgcctagtactggtttaacttgggtcttcctgtgagcagccagggaagacagtgtgcagtttctgggggaaggaaaagaggtcctccttcctcttaaatgcttttctcatctatgtaaggagcattgggctgcatgtttgcccctttcttcagagctgtaaccctcctgtctgtgtgccgttccaggtcactcagttgttcagaaagaggccaagaagagatgctgccgctcttccaccatctcacccctcgttggggtggttcaggctgcaaagccattggtgattcctccgttcctagtgaatgtcctggaaccctggaccatcagaggcaagccagtaggacaccctgccccaggccaccactggcaggaacgcaagggctggtcacagacaccagggctgcacccctgaccccaattggcacccctctgccttcagccattccctctggctactgctcacaggacggtcagacagggcgacagcctctcccgccctacacccctgccatgatgcacagaagcaatggtcacaccctgacccagcctcccggtccaagaggctgtgagggcgatggcccagagcatggggtagaagagggaacgaggaagagggtctcgctgcctcagtggccacctccttctcgagcaaagtgggcccacgcagccagagaggacagccttcctgaggaatcctcagcccctgattttgcaaacctgaagcactatcaaaaacagcagagtcttccaagtttatgcagcacttctgacccagacacacctcttggggccccgagcactccagggaggatctccctccgaatatctgagtctgtcctgcgggactccccgccacctcatgaggattatgaagacgaagtgtttgtgagggatccgcaccccaaggccacgtccagccccacatttgaacctcttcccccacccccacctcctccaccgagtcaggaaaccccggtgtatagcatggatgacttccctccacctcctccccacactgtatgtgaggcgcagctggacagtgaggatcccgaggggccacgccccaggtgagtgagcagactgggcagctttcccccactaacaggagagtgtcatgccccaggtggcccaggtccttctgctggccacagaagaaccctggcatggagatgtttctatacagctcagctcaggacactgttgatctgtttgcctcaggaggtagttggaccagtgtcattgggtactgaggagtcagggtggcagaaatgaaagctgggacccaaggggcacatttcacttctggggacaggataggcttaggcggtccaagtaaatccctcctccctggatgagttctgaatcagttaggaaataagacaaaagaggagggcatatagaagacaaaaacatcacttttattactgacagagctaacattaaagaatatggcttcagattgtaagtgggtctcttgatactgaacccccaagttaaacagctttacctacctcatcaaaggtcatgttagacacacaaatacacatagatattaatatatacagccttgaggcagcctcagtctcaaaagagaagagagactgggatgtgaatgctcagcttctctttccaaaatcactccatgtccatagggaggaataaagagtagggctcaaggtcagtaatgtttagggaaaacctcttggaagctaggagaatgagaaagaagcattccccaacacatagtccctagaacaagtaatctctcaaaacaccaaaaaaacacattgcctgacagcaccttttgagtggctttctttaaacaccacaagagtgacttactaccactacccctgttaacctagacctttcagaaatctctggaatctaacagcaacattcaccagaactgaattcctagtccatcttcctcaggagatgacaacctcctgaccagctgctgggctcaggagcccctttagagtgctgttgttttctaaagaaggggttgatctcaaatgtgactatctcaccctactcctatgtatatatctatgtatgtttgtgtgtctagcatgacctgtgactaggtaggtaaatgtttttagtttcggggttcagtatcaggagacccacttataatcagaagccatattctttaacattagctctgtcagtaacatgtggaagatgtggaaagctacagccctgatgtggaaagcttctccctcagtctttctccaccctcttatcatcacccttctcttatcactctctctttctctctctctcttttttttttttttttaaatatccctggcagcttcaacaaactttctaaagtgacaattgcaagggaaaggcacatgcctggtgcagcccatgtggtaggtagtcagacactggcttccagactccaaacttctatcaagggttcagaggctgagtccacaccaccctccttcatgagcgttcacgcccaacttgctgggtctcttggtgggcagccagcacccatccagactcaaagcctcagccatgatccagtcagtggaactcagggtttagaaaagaaagtcagtcctgatcctcagaagagttcagaagacatcagaacagaggctttggccaaggaaattgtccaccaagacaaatctctagcagacattttggatccagactccaggctgaagacaacaatggacctgatggaaggtttgtttccccgagatgtgaacttgctgaaggaaaacagtgtaaagaggaaggccatacagagaactgtcagctcttcaggatgtgaaggcaagaggtaagtccctggtgatgtcctcagagagacttacaatcacactccttccatggggatgatgataagtctaggactagttgcctgatgttctcctactgccacagctcctgaaccaagagtgacattttatctcagtcttggaggaatggctctggcagtgaggatgtgggacagatatgcaacaacaaagaaagtaatagtaataattataataattgccattagtacccattgttaacgttgtgtgtcaaacattgtattaatttatttatatcaacattatttaattttcacaagaactttctgaggtggctaccaattttacctccatttacaaatgaggaaactgaagtacagaggaattaagaccatgctcaccaaggtcattgaacatgtgagtgatggcacctggatttgatcacagccccatgactgtgcctgtctccagcaattacacagtgcccccagctcagcaaaggtgtacttgccggttctgtatcagagctgctctggcagagaggccctcagagctcggtgctgggaaaggagcaagtggaagtggtgagcgtggccaacgtcttgccaagactgagaggggaagggctttgtaaggaggagagcctagagaaatagattcgtgtactacactgacccttacctctgaggcattaaggtgggtgttggcgcaaatcctgaaaatcaggaaaggtctgagtaggagcgcactgtctggtttggcccagtccgtgagcctctgcttctgaagctccttgagccagccatgtaacacgtgtcccagtgtgcagtctgtgcttttcatttctcctgggttactgcagtattttcttgcatgttttatttccttaaaagactactatgagaaagactgagtagctttcattttctcttaaattttcagtgaaatctttgtggattgacagtctgggactcagcagttagtggcttccagactaaataaaaacagaacattttatccaaatttgggattgcattttaaaaatttccaactgatcctaactaaattactaacaggaacaccacgtttcattttatgggggagagagaaaggaaagagctatgtgatacttacaagctatttgtcacattgtcagaggctcttctgattcaaggccttaactgtcaccttgtccatttcactgcttttattttcagatttgggaaacagactaattgaggtgaagtgatttatccagggtcatgtctttagcaaacacatactgagcacctacaatgtgcaaggcaatccactgggtactatggggaccccaaagataagatttttgtaggtgtgccagtcagttcaccatgggtggttgcagtatggtcattctgttctctgaccactggctgaaggaccaaagtaacatccttagcaaagtatttcctagcattaccactggaaatatatgtttgctccgtcagtttagaagcagaatggtcatggagcttttgcagcactgagaccttcctggggatttaaaaaaaaaaaaaaaaaggcatgcgccatctcctggtggaaataagcattgtcctgttgggcatgagatggccagtagccattgtgagggttggtcagatgccagagaatcccatttgtaatgcggtggacatatctgaaaacaaaaacaaacaaaaatgtatcagaaaatcttttccctgtctttcaattaactggattaaatgtggtcattgttgcttactgggacagttatcaagcaggaaactagtaaagatgattttttgtgtgtgtggttcctaatttcatagtaaaatgatgggctagatgttaaataatatcacaagattaaataaagttcctctccaagagaatcgtacttccatagagtcatttattcagtgggtaggatatgaattataggctgaaaggcaactcaaatgtggtaaaacagagaactactagatagcaggtttctcaattctgagttttttcttcagccttaaaacatccctattatattatcaatgagtagattttatatcttgtattagttcactgcggaccagcaaactgcagatttcccaggattatatgggatagcaggcacacttgagaaggaaaaattttgtgtgttcaagcaacagtgcatagtaggcactagaaagattacatgtaaccaaaggagtataggaaataattgacctaaaacctgaggtttgtgcagcaccttgaaaatactttcacattgattgagtcatggttccacactgcctttctctgaaataaggagtcagtgtcgttcttatatgaatcacaaaagcagagaggttaaatgtcttctccagagtcagctggcgaggccatagccttgactcccactgtcatccctaatgctgcttttggtggttttccatcccaagtttgcctggcttcaacagccctgtacatagtaatcactcattagttaacagttactagtttatcctaatttctgggaaagaaattaaatagaattgttacgcacttctgaatggactgacatctgcagtgaaacaaagcctctggcgtgatctgtgtggctatactttgtgctctttttggcccaggaatgaagacaaggaagcagtgagcatgttggttaactgccctgcctactacagtgtgtctgctcccaaggctgagctactgaacaaaatcaaagagatgccagcagaagtgaatgaggaagaggaacaggcagatgtcaatgaaaagaaggtaaataaagaatgggatgcccttgttcagctttcctcagaaaaattgacaaggtccatgtaatcagcgtggtgactgggcctcttgaggcaggtggggaaaggacctgtcacatcaccagattgcaccaaaatcattagactttggatttacatggcactttaactaatttcctcttagcttttctgtgagtaggcagggcaggtaagctactgtacttttcgtttttacaaataacagaagtgaagcttagagggattattagaagtctcatagccaggacttgaacccaagtccctagcctcctaatccagcaccaggaccccgacactgttctcagctgctggttggccagtgccaacggtgtgtgtaattttcttgtttcatagtcaaaaggaaaattttaaaatctagaaactttttttagggaaggaggccaattgttaaatgacacttctgagaaaaagtaatattaacctttatatcttccccagccctttttgagggacttcagcgaatagcttgaaagtgcagtgctggaatctagttgttagcatttgatactcctacagagatttcaaatgttaagacacttaaaaaatgaccgtgatgctgctgctgtcttcccacatgccatggagatctaaactgggctgtgtctgcaggggagaaagttctcgccttccactttctctatagcaccagaggggctgccttctgctgtgcttgcagctctctatgcagctcaggcatgtgtgctgcaaaggaaagcttgcttgcttcttgctgagcctggaaggtaagtggttttcagtgatcctgattccaggagaaactttctagggtgattttatttcatttgatctacaatgtgtcccaagctgtcttgtctgttggaatgaaaccacaggatatagaccctaggagcagagggtaactggacaggagggatctttgcagcacctctgggtcatggctaacatgctgatgcaaccattgtagtagcaagctccctgctagcccaaagttttcctatttacatacttgtcattgtatacccctgatatatatacctaccccagcactgctgagcacttcatttaacgggtcccctgattgcaaataagaccacttggcttttggtctgtctatatttatcccaaagagagagctatgtatacacccttacatgtatcacgttgccatggcatctttaactgaacgttttacacaatttttttgttattttgttttctgcctttgggcatacctgctttacagttgcagtgtggcaaatactcattgcttttcctccctatcttaatttttaagtgtttttttttctaagttttattttagaatcggggcataggcaggtttgttacaaaggtatattgcatgatcctgaggcttgctgtatgattgtatgcatcaaccaggtagcgagcatagtacccaataggtagttttttaacctttgtcccctttccttccaaccctcttttattccccagtgtctgctggtcccatatttatgtccatgtgtacccaattaactgttttcccatcactttcaattatcaccctctcactcgaagcattatgtggcaaaaagtatttttagactgagaatatgaagaaatagagaattcatccatcctcacgggaaacaacattaggtagtatgtatttcattccaagtgtgggctatgtatttgattttcttttcaacacaatgctgtactatcttacttgcacaaaactcctctgacacttgtactaccacattttatgctaatcagaattagagaatttaagggctggggtcacacagttaatagatgctaaagtcagatttaaccttatgtctttctgaccccaaagcctgctaaaaattgctcccaggtcagctgcctttaaaccttgctgccctgggaactgagctaaactggaggttctctgggtataactaaccagagctagagtttgagattaaaaccagttaaaacccattttaaaccaaaaatatgagaacagcagtgtccgtgacttgaggactgaggagtttcgagtcatttggagtgccttttgggggagtcacgggcttaggaagacaaaaccccactcagggtggaagagatcttagggagaggaaatgtcacagccacataaccagggcctggcacctagcacgtgctcaataaacatttgtttcatgaagttataaagtgcaaaactcccaagttggagtttaccgtttaactgaagaaaaatatccagaagcccactgtggaaaggttataggattcgagtctatggccttgctatcctcaacacatttgatctcagaagctgaccagggtcaggcctggttagtacttggatgggagatcatggtattagaattcagaagaaaaaaaaatctggaagttaagcaactagtttgtcctttcttgacccttttttcttaataaaatggaagtggtaatgatctctcacataatagttgtggggtcaaattaactgacatatatgaatgtgctttttgagctgcagggtgtaagagcatataatatcttaacagagaagtgtttaaggcaatgtcatgtaagtatgcaaatgttgatggcatctggtatctttcatgttaagatgttcagtgagaaggtgccttattgccaacaaggctaggcactttcctaaatcagactcttacgaggaaaaacagctcacatttgttttctctcttcactgtggaaaatgttgcccacagcaccagggggatgatacccacttgccctgtgggcttatctggctcttcagggataaagaaagatgagaaaaggccatttagttaatgaggcctccacatccagttagaatttccttcggttccttcttccctcaatcctttcttctaaggctgtaagtggcctgagggtttgcatcactttgtgagtgtaaaatgttaggctcataaatgcttagtgagaacacaccttctctgtttcagacactgtgctctgccttgggcatacaaacatgaataagacactgtgtctgctttcctggaactttagactggcaagagaggtggattattttagcactacattattggtcttctgatagacacatggactctactgggggagcccaaaggagcagttcctgactcaagagagtagagtcagattttacctcctccaggaagataaaacctgagatcagcattgaagaatgtatcggtaggagtcaggagcattcgagacaaaaggaaaagcataaggagaaaccaaaagataagaaaaagcatggaatgtgtatgataaagaagggtgcttcaagtagtttgatattttggaatgtaacaaaggctcatgattaaataaaaaatcaccaagcttaagccaggcacagtggctcacacctgtaatcccagcactttgggaggccaaggcaggaggattgctggagcccaggagttcgagaccagcctgagcaatatagtgaaaccctatctctaccaaaaatataaaaaattagccaggtgtgttggcgcacaactgtaatcccagctactcggaaggctgaggcaggaaaattgcttgaacccaggaggcagaggttgcagtgagctgagatcgtgccactgcactccagactgggcgacagagcgagactccatctcaaaaaaaaaaaaattaaaaaactaaaaaattagctgagcatggtggcacacacctgtggtctgagctacttgggaggctgaggtgggaggatcgcttgagcccgacaggcagaggctgcagtgaaccaagatcgtgccactccaatccagcctgagtgacagagtgagaccctgtctcaaaaaagaaaaaaaaattaccaaatttagaaaataacaaaggaaggccacaaacagtgggagatgaggctggaagggttcacaagagccagtaggtcataaggtcatgtagggctttgtgtgaaatgctgaagttcggattttatcatatgacaatggagaaccctttgagattttagtttgttgtaatgaactacaagtttataaatgtgtaattgaattttcattggtatcacttacatttacatatctgatttggaaacacaaagttttaaataagtgatgttgttgaaaacatctttaatatattcagcaaaatgcagttttcttcctgaaatacaacaagcttttctaatgatggtttagaaaaatgatacttggtcaatatccattctccaatattgttttgaggtagaatgtagcctttgaccaacttttgcaaagtaataatttgttatttaatatttaaagttattaataacctaagatatatatctaggctaggaactagagtcttggtttactaataactattttataaattaaaaataacactttagtttcactttgatatttctatttatatatcctagatgatgaataatattccaagtaaatgtaagtatcagttaaaatatgaaacttccattgtctgaacttttgatatacgtaaaactaaagacagtgtaaataatcagagctgtcaattttttggctaaagcctgccttattattaagcaaaattctacttaaaccaatcacataattccctattctgaagtccaacaggctttggcttcagaaacttagaggaatatttcaaaaggcaaaaggaatctattgttcctctgagtcagcttttctcaggagatcactggttctcagctgcccattcccgctgctcttccttcattcctgaagttccagctctccctctggtcttacttcctttcagtatttatttcagaataggtctgctgataacacattcttttagttttctccatctaggaatgtctttattccactgtcacccttgaagggcattttcactggatatgggattctgggttgagttgactcttttctttcagtacttaacaaatgttcactttcctcttgcttccatggtttctaatgagaaatgcacagtcctttaaatattggctcctcctgtatgcaatgtgttgttttcctctggccactctctttcgtctttagcattttgattatgatttggatggacttagttttctttgagttgatcgtatttggggtttgctgagcctcttgattctgtaaatttatgtctttcaccaaattctggaagttttcagccattctgtcttcaaatattcttaatgcattaatcttctccctccaggactttagtgactagtgatacagtatttcaatgacagttcatattgtcccacaagctccattcatttttttttaaatctgttttctttcagtccttcagattggataatttctgttggtctgttttcaagttcactgactttcctatctccattctgccagtgattttttttttttttaatttcaaatattatagttttcagttctaaaatttacatttaaaaaatagtttctatttctttgctgagaaggtctctttttaaagttgttttaaagactcttgtagattctgggcacagtggctcatgcctgtaacccagcacttagggaggccaaggcaggcggatctcttgagtctaagagttcaagaccagcctggccaacatggtgaaaccccatctctacaaaaaaaaaaaaaaaaattagccaagtgtggtaatgcgtgcctgtaatcccagctacctgggacgctgaggtgggaggatcacctgagccggggggttgaggctgtagtgagctgtgattatgccagcaatgcctatatgctagaaatggctttatctcgtcctagtttttacaagctaagctgaattccactctattcctaaatcccaaccacttggctagtagtcctgaattactcttaagacggagacacacagaggccaactgtgtgtgtagagtgacgttactggcgatgtggtcttgtcaggggaaggagtattccccctacagacatctatctaatatgagcggtgtgtcatcttcaaattgttgtctaatcttacgactgcacaaaaaatataattagaatgtgtataatactttcatattttccaaagtgattgcaccagccttcaactcttcaaatttctggcctccatttcaacattcatgacttgagaagtcgaatttctagaaaatgcttttgaaaaactcaacagtggaaagaaacaaggcttttcttttcatcctcatggttttcgttatttctgttatgacttcttttgaaactaatatcatatgttgtggtttccgccagcctcatttgagcctcatagtattcttatgagctattttaataaagtgatgaaagtctgaagccagatgatctgcgtttaagcctggctctgtcacgtaccagctgcatggccttgaacaagttaacctctatcctcctcactttcctcatcggtaaacggggataataataatacctctctcaccgggttgttgcaagtagtaattgaatagtaaaacacttaaatggtgtctggcacagagaaagagctgaataattaattagacattattattagttttcggcaggtgttattttcttctcgctgtggataactgagaaacagaaggtcaagtgacttgcctgatgccgaatgttatgtcagagcctcctgcctccttgtccagtgttcatcctgctgtaggcaggaagtggggaagggtccagaggacatttctgcagaggatgaggtgggaggcagggtctatgaagctatgtttgggggaagaactcgtataaatagcatctcacacagggtgagctaacagtttatgccagatgagaagtggataaatgatttcacaaattaagtagctcctgagagactagtgtgttatttaaaacaaaacacacctcttctccctcccccggtgagttattctggtagacattggtaggttttttggaagagatctgcctggcaaagaaatggctatttagtacagccagctttctcttgctgctgtcagtttctcaaatccctcttaactgcattttaaaattcaaattatcatattttaaggggctcgttagggcttttaaaaaattcaaatgccacctaactgaggaacattcagccaggagtgactgacgtgaccactcagtaattctggccttagcatctgtggctgagccatgagatatcacattagagcccagcaaatattaataactttccaaaatcaggttctttccacagaagcctccctgcatcacttctatacattttcatctcattccgttctttcttgcaccgtgaagcctggggtacacacatgctcctgtgacagatttatttatggttctgcccagcactgatgtctctgaaaaccaaaacagggtctgggaaggaaagatggggttgactggatggttgtgtttgaagcccgattgcagtttggctgggtcaagttattttgacccttccagtccactgaaccatgctcacctcagggccacccctgcagtgttgctgatctgcttaggtgccggagagagctgttgacctgagttcagcagaaaatttgaaaggatgagttctctcctctcatcactcaccaccacatgtgagagcaaactacttatccttggtttctgcccatttgcaaattgataagcatcacacatgtcctttaaaataccagcctctggctgggcgcggtggctcacacctgtaatcccagcactttgggaggccaaggcaggtgaataactgaggtcaggagttcgagaccagcctgaccaacatggtgaaaccccatctctactaaaaatacaaaattagctgggcgtggtggcgggtgccagtaatcccagctactcgggaggctgaggcaggagaatcacttgaacccaggaggcaagagtttgcagtgagccgagatcacgccattgcactccagcctgggcaacaagagtgaaactccatctcaaaaaaacaaaacaacaaaaaaagcagcctctaagagccacaggaggatttttaaatacaatgaggccacatgaaataatagtttaataagggttttagttccttccagaaatgacaacacaccatactagtttcaaaaaaagtcattaatagaaataatgaaaaacaggctgaaaaaaaccaccttgtttctttccactatttggtttttaaaaagcattttctagacattctagaaattctgcttctcaggacatgaggttgaaatggacgcctgaaatttgaatgagctgaaggccttttcctgagggtgcagtgataatgttttgccccagtaactatctctttcaatttggtataacccagttgtctttaagtgtcttccagtaacatctagagcaaaaagcctaggaaatgtacccttcgagttaaaaattcctgggctgacttcacatagatgacattctctctcattatctgtctgaaaaacaggaatgatgacatttgacttgtcttaacccagtccagcaggaatgctgggagacacaacagcatgcagtgtttatttttcctgctgctttgcattccagtgtccttgccattttctccatatgcgctgatatcacagtgaaagatcatcacaccctgccaggcattttgctggaggtatataacatgttctcttgcaggtaaatttcatagcttccagccagaattgcttttttggaaaatgaaatttttccaggtgaagataagaaaacttaaataattaatattaagcaattttaacagcttgaggaaaaccaaagattataacctgtgatgagatggtgcagcagatgtgatttttgagacagagtctcattctgttacccaggctggagtacagtggtgtgatctaggctcactgcaaactccacctctcaggttcaagcgattctcctgcctcagcctcctagtagctggggattacagacgcccaccatcacgcctggctaatttttgtatttttttcagtagagatgggctttcaccattttgaccaggtttgtctcaaactcctgaccacaggtgatccgcccacctcagcctcccaaagtgctgggattacaggcatgagccactgcgcccagcctggatgtgaattttttagccacctgcagcctctaggattaggcagattgagaaaacaacaagatgtcaccattaaagccagaacttagacatttcaaggacattatgaacctcactcacttgtgaagtacctctgatggtccgactccaagataggcagattgtggagaaataaatatttccctagtcattgtgattacattcctaatggaccttctctggtgctgatactgaaatagtacaaaaagttgtcagtacctttcaattctgttggtcaaaaatatgtttttcctttttttgtgtgtgtgttttttttttcctttaaaatgaacatatacttccaacatagaagttgtaacctttatatttaaccaagtttccagttgaagccagtttggggtgtgcatgtgtgtgcatgtgtctatatgcgtgtgtgtgtatatacacacacaccaattatatatatagtatgcatgtgtgtatgtacatacagagaatttttgagctggggcctttttagcagtaaaaaaaaaaaagtaagttttaactaaaaaagattgtcttctttccatctagctattttaggctaagagaaaaatgaaagactaattacaaaaaccgtggagtttaatttctgttgtgcaaaagaagcagtagacaatataaatgaattcaaactagaagccactaagacatttacttccttccttcagttaaatatattgggtatttgcttcactgttttataagtatggaaatatgtgattaaggtgtcaaattgcacagctctggtaactggagacaggggaggtagaacaaggggctgactttctgataaaggtcttgctgtcaatttctaatgattgtacaagggtggcccctaaagtgaggctgacttgagttcacttcacctcacaatgtcttagtttcctcccttattataggtagataaaacagtatctactataagattgctgggaagactaagtaacataatcagtgtagagtttctccatatgtatggcacatatcaactgctctacaaatggtagctacaattaatattcaactcagctctaagaccttgggccaatcccttaattcctctgactcttggcctatttgtaaaataagaatactgtttactctacctgcctacttacccatagtattgtcatgaggatcaaatgagaacatgtcttaaaaggacttttaaaaatgagtaattggccaggcacagtggcttatgcctataatcccagcactttgagaagctgaggctggtggatcacttgaggttaggagttcgagaccagtctggccaacatgatgaaaccccatctctactaaaaatacaaaaattagccaggcgtggtggtgggcacctgtaatcccagctactcaggaggctgaggcaggagaatcgcttgaacccaggaggcagaggattgcagtgagccgagattgaaccattgtactccagcctgggtgacaagagccaaactctgtctcaaaaaaaaaaaaaaaaaaaaaaaaaaacagaagacaaagctgtacatagcatgacacaatggaaaacattacaaggttgtgtgtaatcaagtgttggtgtgtgaggtttagagaaaggcaatggtagacccttagggaaagaaggctattatggcataatattgggggacactccatatagagaagggggaggatattcagctgagccttgaagatgacagaaggtggctgggggaggtgacttctgcttccactggcacctcctgttggctgatctttgcggtcttatctgtcatttcaggctgagctcattggaagtctcacccacaagctggagaccctccaggaggcgaaggggagcctgctcacggacatcaagctcaacaacgccctgggagaagaggtggaggctctgatcagcgagctctgcaagcccaatgagtttgacaagtataggatgttcataggggatttggacaaggtggtcaacctgctgctctccctctcggggcgtctagcccgtgttgagaatgtccttagcggccttggtgaagatgccagtaatgaagaaagggtaggtggcctagtgatgcagttcaacaagttctccctcaaagcccacatacatagagaggcgccattagacgccatcctttctctcaggaagatttgtggcaatctctttggggcagggagagaatacatgtataggtaaccaagaaacagagaaggcattttctgtgttgagatataatgctggccaggcgtggtggctcatacctgtaattccagcattttgggagcccaaggcaggcggatcacctgaggtcaggagttcaagaccagcctggccaacatggtgaaccaacatggtgaaaccctgtctctactaaaaatacaaaaattagccaggcaccatggtgcgtgcttgtaatcccggctactcaggaggctgaggcaggagaatcgcttgaacccgggaggcagaggttgcagtgagccgagatcacgccactgcactccagactgggcgaccacatcaaaaaaaaaaaaagatgtactgctgtactgctgacacttaaggctcatggaattcttgggaaagtaagaaccacaggcaccagagtttctttcctcccaactgtcttccttcctttctttcccaaaaagataaaaacatcatgaatacattaaaacagggagggggcaggaacataggcttaaggctccagggcatctcacatgaggggccacaggcactcagtgaggacgcaccagggtgtctccactgcaccccctcctcgaagggagggtacagggggacaggtaacagtgctgaccccactggagacaattcaccaagagcttccacctgtcaggcactgtgagcttatgcgcagtctcatggaatcctcacaacagcccagtgagggagctaggataggaggagtcctactgcagactccaagttgtatcaccgcattgaacagaattccagagctatagagcattcttcatccactcctctgtacggcaaatagttactgggggtctagcgtgtgtcacttagtggtctaggcacatgggatacatttgtgagcaaagcagacagatcctaccctcctgatactgaacaacaaacagtagacacaattattttatatatatgtgcacacagtatgtgtgtgtatgtgtatatacatgctagaagatggaaactactccagccgtgaagaggggctccttttcttgcctatgctaccatcttttttctttttcttttttttttttttttttgagacagagtctcactccgtcacccaggcttgagtgcagtggcgcaatctaagctcactgcaacctctggctcccgtattcatgccattctcatgcctcggcctcccaagtagctgagattacaggtgcgcaccaccatgcccagctaatttttgtatttttagtagagacggggttttaccatattggccaggctggtctcgaactcctgacctcaggtgatccacctgccttggcctcgcaaagtgctggggttacaggcgtgagccaccatgcccagcctaccataccatctttctttttcattgctctcatgaattctccaataatttctcctaatacattgcattaaaaggaaagaggtcctttttcaaatagattttaaaaggattagaaaaagtctggatcctaaacatttaggaaagtgactcagcatttaggaactctgcagcgccactctcagcatcttcctcgtgtaaatgtgctgagtcagcttccttatctagaaatagtctgatactacctaactcagaagtgtgtcctgtcctcctttcttccactcgacaaacagctaacagtagcctgtcaaatatgaggtgctgtgtctgctggggacaaatgctgactaaaacacaggccctgctctccaggaactcacaacttatggaggaaagcagtatggaggagcaattgtgtgctggtgctgagcataatgagaaactcagccaccaaacacttctcaggtgggggagcgtaaggcaggaaggacttcacgcagtgacacatgaatacagtttagaagaacctcttaattctaagaggactgagaggggaagggcctcaccatttagaagaaataccatagacaaagtcaagaaagagatgccatgtttaagaattgatttgcatgtggtttggtatgtctagaacatacagtgattgcttggttttgtttttaaaaatagtgagctaaggctgggtgcagtggctcacacctgtaatcccagcactttgggaggccaaggggggcagatcatgaggtcaggagttcaagaccagcctggccaacatggcaaaacctcctctctgctaaaaatacaaaaattaaccaggtgtgtggcgggtgcctgtaatcccagctactcaggaggctgaggcaggagaattgcttgaacccgggaagcggaggttgcagtgagccgagatcacaccactgcactccagcccgggtgacagagcaagactgtctcagaaaaaaaaaaaaaaaaaagagctatgggaatattagaaactgacagaaagtacatggccccatcaaaagagataaagaagaaagttcaaagaaggtgtgggaaggattaagggggaaaccaggaaggggtaatgagggctcgccccttgtccctcacccagagctatagcatcagcagcaaagccattatgggcctctttctgaagggacaaggagaagggagccctgatcagaaccatagctgcagctgccctatagcactgaggccctggtaaaagaatgcaactgccaccaactcgaagcctggcacagaggcagccagggatacatgccacagtttcttttcgcactctccagtctcttttccatcactccccttggtcaaacccagacagcaagggagcccagtggatgcaacccctagagttcagcttccttcagcacagggcagagaagagtggacctggagaggcagacacaatatccagcacagaaaatcatcacaaagaccttaccacagtcatacactagactttagacttcagcctataggtagggaagagtcatgaactaactttgtgacttactcagcctggggaggggcaagattgatgttaaaataacagttgggaggctcattttaatagtctaaacaaggagggtttatgctgttgatgtaggcaattgtcctgggggtagagaagaggggataaattagagaatgaatttgtattagcaaggggcatgttagatgaggggaagggtagagcagaaaataattccaagtttcctattgggccacctggatgaatgctctagatatctgagacaagaaagactggagcagtttctagttagggcaagataaattgttttagaaccgaattaaattcaacacttacatgcatgcctgcactcttaaatacaagtaagtttgctcacccaaaaaatactatagcagtattgtttttttatcatgattggtctttgttaagaaactaaaactataagtagaaatgagaaaaggaagaaaaatagttaccaaatggggagtagtgaagaccaggattggggaggagtatctataaggctttaactgaatctctaaaaaaaatttttttaatctgcagccaatatgaaaaaagtgttcatattaagatttggcaccattaatgataggtacacagagtgattctttatacattactgatgtctaaaatattttatatattttttaaggtaggtgatgaaaaaattctcaattttttaacttacatctcaatgatactttgaaaggcatcctcattcaaattcagtccctcagggttttttggggttttttttttgttttttttttttttaaggtatgtttttctgcttagggaaaggaaacttatgccaataagcctgtaattcttcacttttcccccaggcattattatgtaagatgtgacaggctagtttagggggatttagggcaaagacacatgagtctttgataaccctacataagctattttgtattgaggtatacttaagtgatcttatttcttgattgattttcattttaattttccacaatcactttttttttatttcaataggtttttggggaacaggtggtgttttgttacattgataaattcttagtggcgatttctgtgattttggtgcctccatcacccgagcactgtacactgtacccgatgtgtagtcttttatccctcacccacctcccacccttcccgctgagtccccgaagtcctttgtatccttcttatgcctttgcatcctcaatagcttagcatccacttaaaactgagaacataaaacgtttggttttccattcctgagtcacttcacttagaataatggtctccaactccatccaggttgctgtaaatgccattattttgttcttttttatggctgagtagtagtccatggggtgtgtgtgtgtgtgtgtgtgtaaaccacaatgtgataccaccttactcctgcaagaatggcaataaaaaaaaatacatgttggcatggatgtggtgaaaagggaacacttttacactgctggtgggaatgtaaactagtacaaccactatggaaaacagtatggagattccttaaagaactaaaagtacatctatcatttgatccagcagtcccactactgggtatctatccagaggaaagaagtaattatatggaaaagacacttgcacactcatatttatagcagtacaatttgcaactgcaaaaaagggaaccagcccaaatgcccatcaattaacaagtgaataaagaaaatgtgtgtgtgtgtatatatacataacatatttgtatatgtgtatatacacatatatacacatactatatatatacacacaccatatatatgtgtacatacacatatatacacatatatatacacacatactatatatatacacacacacacacacatacatatatacacacataccacattttctttatccacttgttaattgatgggcatttgggctggttcccttttttgcagttgcaaattgtgctgctataaacatgggtgtgcaagtttcttttccatataattacttcttttctctggatagatacccagtagtgggattgcaggatcaaatgatagatgtacttttcattctttaaggaatctccatactgttttccatagtggttgtgctagtttacatccccaccagcaatgtaaaagtgttcccttttcaccatatccatgccaacatatattagtttttgattatggccattcttgcaggagtaaggtggtattgcattgtggttttgatttgcatttccctgatagaactgttcagcagtttttcacgtttgttgaccatttgtccatcttcttttgagaattgtctattaatgtcctttgcccactttttgatgggattttttcttgctgatttatttgtagattctggatattagttctttgttggatacatagtttgcaaagattttctcccactctgtgggttgtctgtttactctgctgtttttattttgctgtgcaaaagctctttagtttaattaagtcctatctatttatctttgtttttgttgcattcccttttggattctttgtcatgaactctttgccgaagccaatgcctagaagattgtcttctttccatctagctattttaggctaagagaaaaatgaaagactaattacaaaaaccgtggagtttaatttctgttgtgcaaaagaagcagtagacgcttaatataaatgaattcaaactagaagccactaagacatgtacttccttccttcagttaaatatatcttctagaatttttatggctttaggtcttagatttaagtccttgatccatcttgaatagatttttgtgtaaggtgagagatgaggatctactttcattcttctacatgtggcttaccaattattccagcaccatttgttgaatagggtgacctttcttcactttgtttttgtttgctttctcgaagatcagttggctgtaagtatttggctttatttctgggttctctattctgttccattgctctatatgcctgtttttacactaataccatgctgttttggtgactgtggccttgtagtatagtttgaagttgggtaacgtgatgcctccagatttgttctttttgcttagtcttgctttggctatgcgggctcttttttggttccatatgaattttaggattgttttttctagttctgtgaagaatgatggcggtattttgatgggaattgcattgaatttgtagactgcttttgacagtatggtcattttcacaatattgactctacccatccatgagcacaggatatgtttccatttgtgtgtgtcatctatgatttctttcagcagtgttttatagttttccttgcagaggtctttaacctccttgattaggtatattcctaagtattttatttttttgcagctattgtgaaagtggttgagttcttgattttattctcagcttggtcgctgttggtgtatagcagtgctacttatttgtgtacattgattttgtatcctgagactttactgaattcatttattagatctaggagctttttggatagtcttcagggttttctaggtataggatcatatcgttggcaaacagcaacagtttggcttcctctttaccaatttggatgccctttctttctttctcttgtctgactgctctggctagaccttttagtacaatgttgaatagcagtggtgaaagtgagcacccttgtcttgttccagttctcagggggaatgctttcaacttttccttgttcagtataatgttggctgtgggtttgtctcctcagttactttgcctaaaatgtctgaatggttaaatataatttttttaatttaaaaatgatcatgttggagagaaaaccacattaaagataacatatgctacaatatcatagaaaagcataagaaactcttagaatatgacattgccgtcattgttgaacagaatttctctcattttggatcagaggcctgcaaaagagaactgaaaaaatggaaactggcttctttagagatgggaaatatgatctcattgctattatggattagggagaggttctcaaactttagccgcaaaagaatcatctggaaggcttgttaaaacaggttgctgggcctcacctccagagttttttattcaagaggtggaagagggcctgaacccttgcatttctaacaatttcccaggtgatgccactgctgctggtccagcaaccacaccttgagaaccaccgtattcatgtatatactcaaggtaccttgatgatttttttttttttttttgagacaagagtctcactctgtcatccaggctggagtgcagtggcacatctcggctcactgcaacctctgcctcctgggttcaagcaattctcatgcctcagcctcccaagtagctggtattacaggcatgcatcaccatgcctaggtgatttttgtatttttagtagagacggggtttcaccatgttggccaggctgggtttgaactcctggcctcaagtgatccatccatcccggcctcccaaagtgctggaattataggcgtgagccaccaagcccagctgatgattggtttttaaagtcaagaatctgaaagcaattttatctccagccaatttaatgtaacagctctcaaactgaagctatcctatgatgttacaatttagagaatgctgtaatatgtaatataaggataatctgattttcaaaaagttagcctccttacttaggagtgacaataggaatagagcttagatatttcccagtcctgtcagaggtgtccttgcagggagtctggctcttttctccctttccctggccttcattgatctgtccaattttccctggcagagctctctttacgagaaaaggaagatcctggctggtcagcatgaggatgcccgggagctgaaggagaacctggatcgcagggagcgagtagtgctgggcatcttggccaattacctttcagaggagcagctccaggactaccagcacttcgtgaaaatgaagtccacgctcctcattgagcaacggaagctggatgacaagatcaagctgggccaggagcaggtcaagtgtctgctggagagcctgccctcagatttcattcccaaggctggggccctggctctgcccccaaacctcacgagtgagcccattcctgctgggggctgtactttcagtggtattttcccaacattaacctctccactttaacctcttctaaaatacccaaccaaaagatcactgtttctctcaacactatttaatctgaaaaatgtttcagtacaaaccactgtttgaactatctgggttattggtgtttgttcctgatgaaaggaaaaaaattctctccaggaggaagcctttttccttcttgcccttcctgattgatcttctgagagctcgaatgctgctggacacgtacccctttctattattactttgtagtagaaagaaagttaatgaaactgagaactgattggagggtgtttgatcatttagtttttaacaggctgaggcaacatggatcagtgtgtgtccccctcaggaatgtatccacagtggccttccttgctggtgggcagtgtatcctgatggcagggtacaagtaccattaatgaagggtctgcaacataaagccttaaaaagacacacactaagaaaactgtaaaaccttgaacattgttatttatattttttaaaatggaaaagatcactatgtttgttgtgctaaccacttatttgattctgttttgtggtggacatagatgattacgtttgagctttgtattttgtgaaaaccttaatgaaatgaattccaaagatagtcacgttgagcgtgaagactttttttcttacattcctgtcttatttttaccaacacgagcaggcattctgcgcttccactggactgagtatgggggagtcctgctcccctcctgtctcacaccttccccaggaggaaggcctcatgcactgcggttattgcatcatttcctagtgcttcatgtcattatcactggtggggaaacaaagctaaattttattaacaaagacaactctcagacctatataataggaggaggacgtccagaatccaacaaaattcaaacggagcccatgctgttctcctgaacaagatttgggctaaatacggcctgtttattgaggctgttttaatgatgctttaaaaaaaaaaaatgttttctaaaatgtcaaacctgttgaccacactttgattaaaaactgcctccttaacctctgaagactgattttgctttatcatgtttcaataataacatttcagaggttactctgtagccccagttgtaagcttataaaaacaaactggaaggctgaggaggttatgggctggcagccaggctatgtttacagctgctggagatggcagtagccttatactttgagcaggtagtacatcccaggctgtgctagaggtagatttgttttttcacgtttgatctgtggctggtggccacctttgttgatttgggcttacgagtttcatagtagccagtcttagaaaattgggggagtaaaattttgaagtaaaaaaaaaaaaaaaatgacaagggaaccaaatgctccttctccccttagtacattttcattacttaatgaagttttatctcctatgtaagaatatcaaaattgtagtttgggtctccagtagagatgtcttttgattaacttataaacaactggccacccagaagtttcctttgcatagtcaaccaaagctatggctttgttctttggagcttatatactgcatgactccattgatacaaataagacagcaccttggtttcccagggatgttttcattcagaggtcctgtctcccaggaaagcagtagaaccagtgacagcattcaacagccacactgcatggtcatcagtcttaggccaacatgggagcctgaaattaactccatcagtaactacctgtgtgtcttgctgatactgaatgagccctcacaagccaagccaggtggaagacagccagcaaacgtctacagttattcttagtgaaattcctcagaggaatccagggggctcccagttcccaacactcttcgagatgaccatttttcgggatttgactggggaacattttacatattcagtctttctcaaaaatttttatttattttcttgagaaagggtcttactatgttgcccaggctggagtgcagagtggtgcgataacagctcattgcagtctgaacctctgaggctcaagccatcctcccatctcagcctcccaagtagctgggaccacaggtgtgcaccactatgcttggctaattttttgattttttatagagacgggggtctcgctatgttgcccaggctggtttcaaactcctgggctcaagggatccttccgctttggtcccagaagtgctgggattacaggcatgagccacttcacccagccacttttctaatttatagacataaaagtaattgactcccacagcacagtaacaggcaatgctgcttggcatgccacaaacatctgaaagcttgtgacactcctaggattgtgtccattctttcattatgtggaaactttgttctgttatgtgaaatgggtaaggcaccaagtgagactttgaaatctaatttttaggtggatgtgatatttattgtaataggacttgacctctgtactttaaagaaatcactaaccaaattttcaaagtttccttttaaatgcgtttagctagaaatctatgtatttatccctttcctattttgcattcttctcccactatttttaaaaactcatttacagtagaaaccattcttctttctcccaacagtatcctttgccaagaccatgagaacagtaaggagcatgttgttggtcagggtttcagaatacgcgtgatgtcactgagaatgtttgctcacagtcaataattgtctttgtggatgtgataattttggagatacacttctggtcagaactcaggtgagataatcttgcaatactccaaatgcagatactccagccacccgcaaggttccaggaaaggacaatgtcctgcgagaaaatcaggaggcctccacttcctgggccacttgagaagttcctgggcatgtcactacatgttggttgactcagccatttctcatgctgttttgtttcttgcggtggccacttaaccccaaagaatgaagggaggatccacagtgaaagtgcctgagtttctctatgagaccagatgctgtcgaaaccaaacatcttttcctttgctctatgggaacattttagggtttgttttgcacagctggtttccagactagaagattaacaagtttgggtccacccctaagaatcagtggctgtcttttaaggtgaggagtgtgggcttaactgaggtcctttgagggagctataaaggagaaacaacctgggacatcccagttttcctattcctccactgttaatatctcatctaaaataattcatgagtttaaatggtaaatatatgctttaagctctacctttaaacttgtatgttattcaggcatctcttattaagatactgggtctctggatacccaaggaaatgttggctttttattcttatgtggttccaaatttacttctcttcagtttaattgtccatggtagtgctggcttcattgttaggttggagttattattttccttttagaacaacatgaattttattcaccttactattagaaaaaggaataactacagccagaaataacttcatttcctacaaggtataaaaagtggtcaagtgaatgtgaaggggcttttctacacaggaatatattatcgggaacaaagtatttcctgctgccttaactctttgggatgcataggataaaatgataaagaccattttaatatcagaaagggttgtcttattaatttttaaataaaacttcacatttcttaatggggagctcattcagaaactaaataatggtttctcaaagtgtggtcaggatacgatctgcatcagaatccttggaatgcttgttaaaaataccaattgctatgacaaaaccaagtctgctggaaactgcatttcagcaggtttcccatgttattctgatgtattttaacatttgagagccactaccaatcatctgtacagttcctactgttatgatcacaataagactaacatgaatttaataatctgaataatttttaaaatttaaataaacagaaattgaagttaaatttaaaaataaaaataacctcagaagttgaa
